US012643942B2

(12) United States Patent
Caligiuri et al.

(10) Patent No.: US 12,643,942 B2
(45) Date of Patent: Jun. 2, 2026

(54) HINGE-MODIFIED IgG ANTIBODY COMPOSITIONS FOR PROTEASE RESISTANCE AND FC-γ RECEPTOR BINDING AND METHODS OF MAKING THE SAME

(71) Applicant: City of Hope, Duarte, CA (US)

(72) Inventors: Michael A. Caligiuri, Pasadena, CA (US); Hongsheng Dai, Monrovia, CA (US); Tongwen Zhang, Monrovia, CA (US)

(73) Assignee: CITY OF HOPE, Duarte, CA (US)

( * ) Notice: Subject to any disclaimer, the term of this patent is extended or adjusted under 35 U.S.C. 154(b) by 159 days.

(21) Appl. No.: 17/637,433

(22) PCT Filed: Aug. 24, 2020

(86) PCT No.: PCT/US2020/047675
    § 371 (c)(1),
    (2) Date: Feb. 22, 2022

(87) PCT Pub. No.: WO2021/041336
    PCT Pub. Date: Mar. 4, 2021

(65) Prior Publication Data
    US 2022/0380457 A1      Dec. 1, 2022

Related U.S. Application Data

(60) Provisional application No. 62/891,200, filed on Aug. 23, 2019.

(51) Int. Cl.
    C07K 16/18         (2006.01)
    A61P 35/00         (2006.01)
    C07K 16/28         (2006.01)

(52) U.S. Cl.
    CPC .............. C07K 16/18 (2013.01); A61P 35/00 (2018.01); C07K 16/28 (2013.01); C07K 2317/53 (2013.01); C07K 2317/72 (2013.01); C07K 2317/94 (2013.01); C07K 2319/03 (2013.01)

(58) Field of Classification Search
    CPC ............ C07K 16/2803; C07K 2317/53; C07K 2317/72; C07K 2317/94; C07K 2319/03; C07K 2317/524; C07K 2317/565; C07K 2317/92; C07K 16/32; C07K 16/2887; C07K 2319/50; A61P 35/00; C12N 2510/02
    See application file for complete search history.

(56) References Cited

U.S. PATENT DOCUMENTS 7,317,091 B2      1/2008   Lazar et al.
2010/0331208 A1   12/2010  Gao et al.
2015/0139984 A1    5/2015  Brezski et al.

2015/0166636 A1 *   6/2015   Igawa ................ C07K 16/2848
                                                            530/387.3
2015/0315284 A1 *  11/2015   Lazar .................... C07K 16/32
                                                            435/69.6
2017/0058030 A1 *   3/2017   Georgiou ........... C07K 16/2887
2019/0092871 A1     3/2019   Tavernier et al.

FOREIGN PATENT DOCUMENTS

WO    WO-2013/000234 A1     1/2013
WO    WO-2018/049248 A1     3/2018

OTHER PUBLICATIONS

Zhou, C., Jacobsen, F. W., Cai, L., Chen, Q., & Shen, D. (2010). Development of a novel mammalian cell surface antibody display platform. mAbs, 2(5), 508-518. https://doi.org/10.4161/mabs.2.5. 12970 (Year: 2010).*
Ryan MH, et. al. Proteolysis of purified IgGs by human and bacterial enzymes in vitro and the detection of specific proteolytic fragments of endogenous IgG in rheumatoid synovial fluid. Mol Immunol. Apr. 2008;45(7):1837-46. doi: 10.1016/j.molimm.2007. 10.043. (Year: 2007).*
Rudikoff et al Proc Natl Acad Sci USA 1982 vol. 79 p. 1979-1983 (Year: 1982).*
IMGT.org, "Correspondence between the IMGT unique numbering for C-DOMAIN, the IMGT exon numbering, the EU and Kabat numberings: Human IGHG", accessed Aug. 16, 2025 (Year: 2025).*
Janeway CA Jr, Travers P, Walport M, et al. Immunobiology: The Immune System in Health and Disease, "The structure of a typical antibody molecule" 5th edition. New York: Garland Science; 2001 (6 pages) (Year: 2001).*
AntibodySystem, "IdeS Protease and IdeZ Protease: New Tools for the Characterization of Antibodies" published Apr. 29, 2022 (Year: 2022).*
International Search Report mailed on Feb. 8, 2021, for PCT Application No. PCT/US2020/047675, filed Aug. 24, 2020, 6 pages.
Jordan, S.C. et al. (Aug. 3, 2017). "IgG Endopeptidase in Highly Sensitized Patients Undergoing Transplantation," *N Engl J Med* 377(5):442-453.
Kinder, M. et al. (Oct. 25, 2013, e-published Aug. 28, 2013). "Engineered protease-resistant antibodies with selectable cell-killing functions," *The Journal of Biological Chemistry* 288(43):30843-30854.
Kobs, G. (Oct. 19, 2015). "IdeZ Protease: A New Tool for the Characterization of Antibodies-Promega Connections," located at <https://www.promegaconnections.com/idez-protease-a-new-toolfor-the-characterization-of-antibodies/> 5 pages.

(Continued)

*Primary Examiner* — Gregory S Emch
*Assistant Examiner* — Kathleen Cunningchen
(74) *Attorney, Agent, or Firm* — Mintz, Levin, Cohn, Ferris, Glovsky and Popeo, P.C.

(57) ABSTRACT

Provided herein are antibodies, recombinant proteins, and methods of use thereof including, for example, immuno-globulin G (IgG) antibodies and recombinant proteins including a Fab region and an Fc region connected through a hinge region, where the hinge region is resistant to cleavage by a protease. Also, provided herein, inter alia, are immunoglobulin G (IgG) antibodies and recombinant proteins including a Fab region and an Fc region connected through a hinge region, and where the Fc region has higher affinity for a ligand compared to a wildtype Fc.

20 Claims, 24 Drawing Sheets

Specification includes a Sequence Listing.

(56) References Cited

OTHER PUBLICATIONS

Suzuki, S. et al. (Nov. 22, 2018). Engineering the hinge region of human IgG1 Fc-fused bispecific antibodies to improve fragmentation resistance, *Science Reports* 8(1):17253.

Written Opinion mailed on Feb. 8, 2021, for PCT Application No. PCT/US2020/047675, filed Aug. 24, 2020, 14 pages.

Zhou, C. et al. (Sep.-Oct. 2010, e-published Sep. 1, 2010). "Development of a novel mammalian cell surface antibody display platform," *MAbs* 2(5):508-518.

Extended European Search Report mailed on Dec. 18, 2023 for EP Patent Application No. 20858827.7, 18 pages.

Jarnum, S. et al. (Sep. 2017, e-published May 22, 2017). "Enzymatic Inactivation of Endogenous IgG by IdeS Enhances Therapeutic Antibody Efficacy," *Molecular Cancer Therapeutics* 16(9):1887-1897.

Maenaka, K. et al. (Nov. 2001, e-published Sep. 5, 2001). "The human low affinity Fcgamma receptors IIa, IIb, and III bind IgG with fast kinetics and distinct thermodynamic properties," *Journal of Biological Chemistry* 276(48):44898-44904.

Mimoto, F. et al. (2016). "Fc Engineering to Improve the Function of Therapeutic Antibodies," *Current Pharmaceutical Biotechnology* 17(15):1298-1314.

Vidarsson, G. et al. (Oct. 2014). "IgG subclasses and allotypes: from structure to effector functions," *Frontiers in Immunology* 5:520.

* cited by examiner

FIG. 3

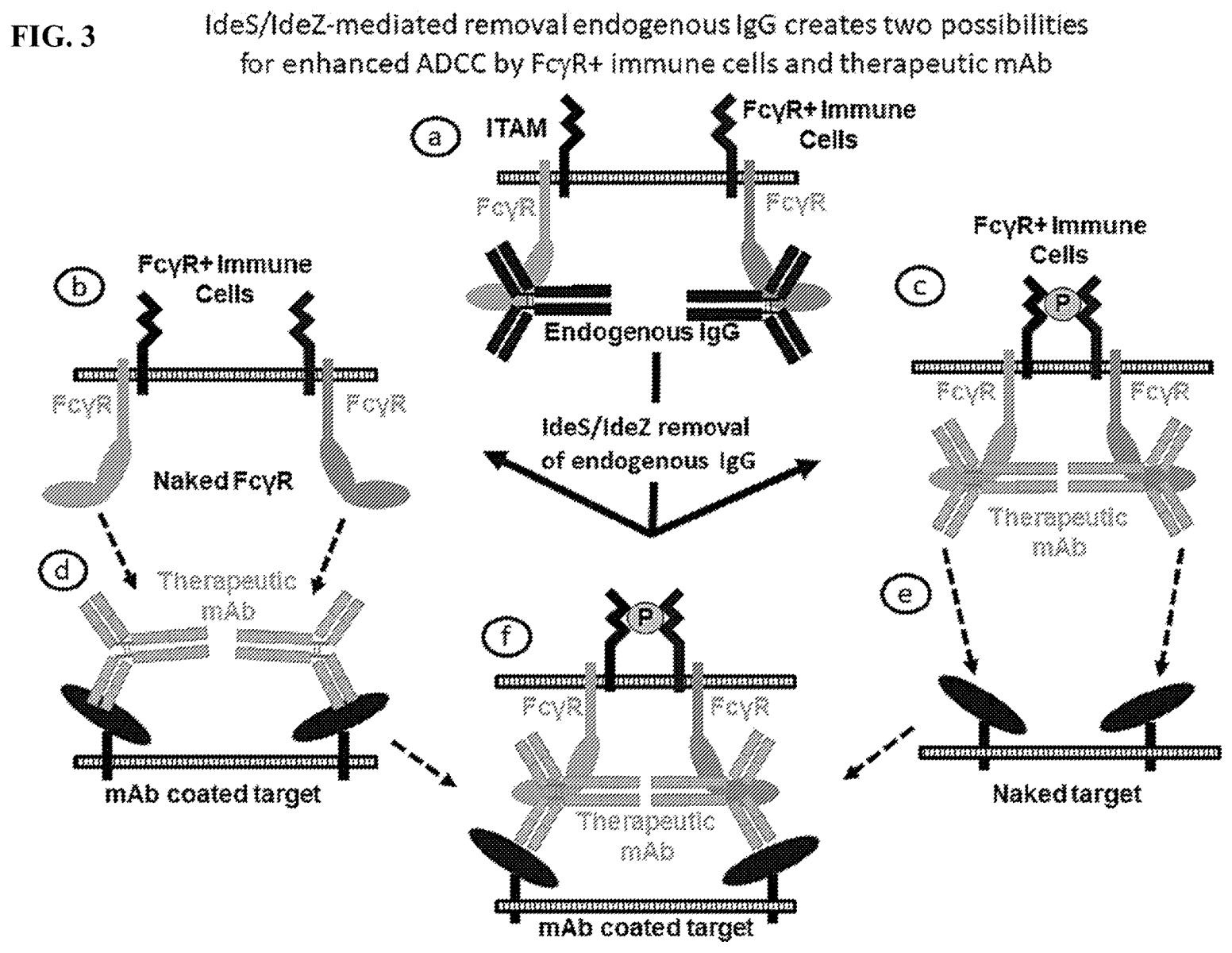

IdeS/IdeZ-mediated removal endogenous IgG creates two possibilities for enhanced ADCC by FcγR+ immune cells and therapeutic mAb IgG1Fc-EGFR Rituximab-
EGFR Hu CD32a

GFP control peptidase

IgG1Fc-EGFR

Rituximab-
EGFR

Hu CD16a

GFP control peptidase

FIG. 5

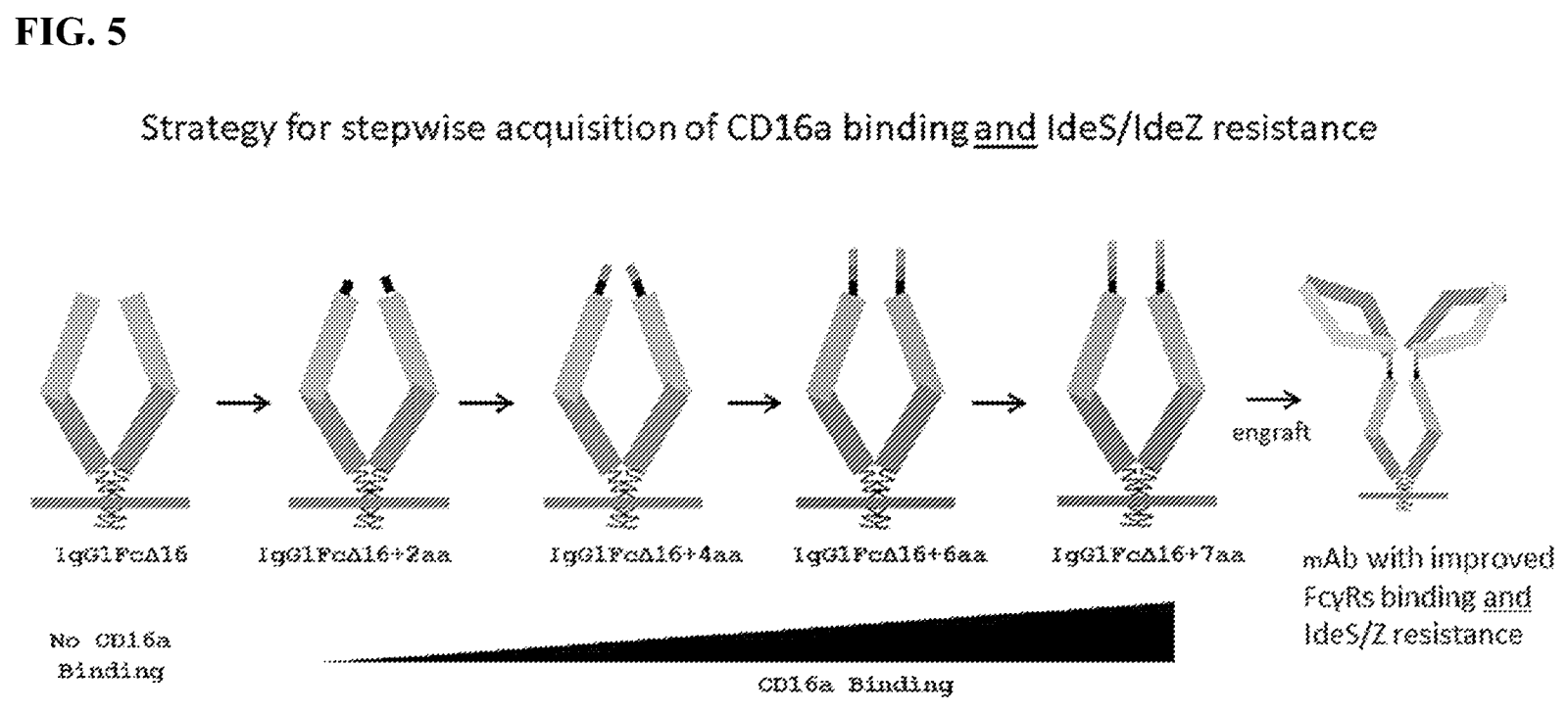

Strategy for stepwise acquisition of CD16a binding and IdeS/IdeZ resistance

IgG1FcΔ16     IgG1FcΔ16+2aa     IgG1FcΔ16+4aa     IgG1FcΔ16+6aa     IgG1FcΔ16+7aa

No CD16a Binding

CD16a Binding engraft mAb with improved FcγRs binding and IdeS/Z resistance

| Clones | CDR1 WT: tataccttcacaagctataac | Clones | CDR2 WT: atttatcccgggcaacggcgat |
|---|---|---|---|
| P01A09 | TATACCGGGAAGCGGGTATAAC | P04D06 | ATTTATCCGGGCTTGTATCTT |
| P01B01 | TATACCTGTtTTAGGTATAAC | P04F01 | ATTTATCCGGGCACGCTGCTG |
| P02C12 | TATACCTTCACAATTCGTTTG | P04F02 | ATTTATCCGGGCCATATGGGG |
| P02F01 | TATACCGGGCGTTTTTATAAC | P04G03 | ATTTATCCGGGCATGCTTTGG |
| P03A05 | TATACCAGTTGGATGTATAAC | P04H06 | ATTTATCCGGGCGCTGTTTCG |
| P05B09 | TGGTTGTGGACAAGCTATAAC | P04H07 | ATTTATCCGGGCACTCATAAG |
| P05H07 | TATACCTGGGGGATTTATAAC | P06A06 | ATTTATCCGGGCACTCAGTCT |
| P04A02 | TATACCTTCACAAGGTATAAT | P06B11 | ATTTATCCGGGCAATGCGGAT |
| P05F06 | TATACCTTCACATTTCCTTAT | P06H01 | ATTTATCCGGGCCAGTTTTGAG |
| P07C04 | TATACCGGGTATTCGGGTATAAC | P04D09 | ATTTATCCGGGCACGTTTCTT |
| | | P05A03 | ATTTATCCGGTTACGGGCGAT |
| | | P05A12 | ATTTATCCGTATCTGGGCGAT |
| | | P05B02 | ATTTATCCGTGGAATGGCGAT |
| | | P06B04 | ATTTATCCTCTGTGGGGCGAT |
| | | P06B11 | ATTTATCCGGGCAGTAGTCGT |
| | | P06H05 | ATTTATCCGGGCACTTTTCGT |
| | | P06H11 | ATTTATCCGGGCGTTGGTCGG |
| | | P07F02 | ATTTATCCGGGCTCTGAGGCG |
| | | P07F10 | ATTTATCCGGGCAGTAATATG |
| | | P08B05 | ATTTATCCGGGCGCTTTTCTT |

FIG. 14 (Continued)

| Clones | CDR3 WT:<br>cgcagcacctattatggcggcgattggtattttaac |
|--------|------------------------------------------------|
| P07C02 | CAGTCTATTTATTATGGCGGCGATTGGTATTTTAAC |
| P07H08 | CGCAGCACCTATTATGGCGGCGATTGGCTGATTGCT |
| P07H10 | CGCAGCACCGTGGCGGGGGCGATTGGTATTTTAAC |
| P08A01 | CGCAGCACCTATTATGGCGGCGATTGGCGGTGGCGG |
| P08B11 | CGCAGCACCTATTATGGCGGGTTTTGGTATTTTAAC |
| P08G02 | CGCAGCACCTATTATGGCGGCGATTGGTCTTGGGCT |
| P07A06 | CGCAGCACCATGTGTAAGGGCGATTGGTATTTTAAC |
| P08E05 | CGCAGCACCATGTTGGGTGGCGATTGGTATTTTAAC |

FIG. 14 (Continued)

HINGE-MODIFIED IgG ANTIBODY COMPOSITIONS FOR PROTEASE RESISTANCE AND FC-γ RECEPTOR BINDING AND METHODS OF MAKING THE SAME

CROSS-REFERENCED APPLICATIONS

This application is a Section 371 US national phase of International Application No. PCT/US20/47675 filed Aug. 24, 2020, which claims priority benefit to U.S. Provisional Application No. 62/891,200 filed Aug. 23, 2019, which is incorporated in its entirety by reference herein.

STATEMENT AS TO RIGHTS TO INVENTIONS MADE UNDER FEDERALLY SPONSORED RESEARCH AND DEVELOPMENT

This invention was made with government support under grant no. P01CA163205 awarded by the National Institutes of Health. The government has certain rights in the invention.

SEQUENCE LISTING

This application includes a Sequence Listing created on Apr. 8, 2025 and submitted electronically as an ASCII file named 048440-730N01US_SL.ST25.txt that is 8,76,996 bytes and is incorporated herein in its entirety.

BACKGROUND

Antibody dependent cellular cytotoxicity (ADCC) represents the main mechanism by which immune cells recognize and clear pathogens or tumor cells following the development of adaptive immunity or therapeutic monoclonal antibody (mAb) infusion. Natural killer (NK) cells are the main effector of ADCC and express the low affinity Fcγ receptor FcγRIIIA/CD16α (CD16α hereafter). However, the concentration of endogenous IgG in human blood is 30-10 μM, which is approximately 100-fold higher than the disassociation constant (Kd) for the CD16α-IgG interaction. Indeed, here we provide evidence demonstrating that human NK cells are naturally coated with endogenous IgG, whose excess competitively inhibits therapeutic mAbs such as Rituxan from binding CD16α and inducing ADCC.

IdeS is an endopeptidase enzyme derived from *Streptococcus pyogenes*, and it specifically cleaves at Gly249 in the lower hinge region of the IgG heavy chains, a region essential for CD16α binding. IdeS cleavage of IgG leads to the elimination of FcγRs binding of IgG and consequently, it is released from the NK cell surface freeing up FcγR's binding sites. IdeS has been safely infused into patients in past clinical trials and the cleavage of IgG has been demonstrated in those patients (Jordan et al.). There remains a need for improved cancer therapeutic antibodies.

Provided herein are, inter alia, solutions to these and other problems in the art.

BRIEF SUMMARY

Described herein is a strategy to enhance the efficacy of therapeutic mAb involving (1) making mAbs resistant to IdeS, and (2) removing endogenous IgG binding to FcγR using IdeS. In vitro data described herein demonstrated that this additional availability of FcγR binding sites on CD16α+ NK cells, monocytes and macrophages (CD16α and CD32α) and granulocytes (CD64) results in abundantly more binding of the therapeutic mAb and therefore improved efficacy of the therapeutic mAb against the tumor cell target or other relevant target via ADCC.

In an aspect, provided herein are immunoglobulin G (IgG) antibodies including a Fab region and an Fc region connected through a hinge region, where the hinge region is resistant to cleavage by a protease.

In an aspect, provided herein are immunoglobulin G (IgG) antibodies including a Fab region and an Fc region connected through a hinge region, and where the Fc region has a dissociation constant of about $1 \times 10^{-5}$ M to about $1 \times 10^{-13}$ M to one or more of CD32 (FcγRII), CD16 (FcγRIII), and CD64 (FcγRI).

In an aspect, provided herein are recombinant proteins including a Type I transmembrane domain and an immunoglobulin G (IgG) antibody, where the transmembrane domain is fused to the C-terminus of the IgG antibody and the recombinant protein is resistant to cleavage by a protease.

In an aspect, provided herein are recombinant proteins including a Type I transmembrane domain and an immunoglobulin G (IgG) antibody, where the transmembrane domain is fused to the C-terminus of the IgG antibody and the recombinant protein includes an Fc region with a dissociation constant of about $1 \times 10^{-5}$ M to about $1 \times 10^{-13}$ M to one or more of CD32 (FcγRII), CD16 (FcγRIII), and CD64 (FcγRI).

In an aspect, provided herein are isolated nucleic acids encoding a recombinant protein described herein.

In an aspect, provided herein are expression vectors including an isolated nucleic acid encoding a recombinant protein described herein.

In an aspect, provided herein are cells including an expression vector described herein.

In an aspect, provided herein are anti-CD20 antibodies including antibodies with CDR variants as set forth in FIG. 14.

In an aspect, provided herein are methods of binding a ligand to a CHO cell surface recombinant protein including contacting a ligand with a CHO cell surface recombinant protein, where the CHO cell surface recombinant protein includes an epidermal growth factor receptor (EGFR) transmembrane domain and an immunoglobulin G (IgG) antibody. The EGFR-transmembrane domain is fused to the C-terminus of the IgG antibody, the IgG antibody is capable of binding a ligand, and the CHO cell surface protein is resistant to cleavage by an IgG-specific protease or has higher binding affinity for one or more of CD32 (FcγRII), CD16 (FcγRIII), and CD64 (FcγRI).

In an aspect, provided herein are methods of treating cancer in a patient including administering a therapeutic IgG antibody and an IgG specific protease, where the therapeutic IgG antibody is resistant to the IgG specific protease.

BRIEF DESCRIPTION OF THE DRAWINGS

FIG. 3 schematically illustrates the strategy for enhancing therapeutic efficiency of mAbs. Panel (a) shows FcγRs on immune cells are normally occupied by endogenous IgG; Panel (b) and (c) show IdeS digestion can remove endogenous IgG and free-up FcγR binding sites for infused therapeutic mAb, which are engineered to be resistant to IdeS and retain FcγR binding function; (Panels (c) and (d)); Infused therapeutic mAb may first bind onto unoccupied FcγR as shown in Panel (c) or may first bind tumor-associated antigen expressed on the cancer cell as shown in Panel (d). Regardless, once the antigen-mAb-FcγR cross-link, the FcγR+ cell undergoes immune activation as shown in Panel (f). The flow chart illustrates that the more FcγRs that are unoccupied and therefore available for binding the therapeutic mAb, the more tumor cells are eliminated (Panel (e)).

FIG. 4A quantifies the ability of an mAb recognizing the Fab portion of IgG to bind to IgG1Fc-EGFR, which does not have a Fab portion (top) or rituximab-EGFR (bottom). FIG. 4B quantifies the ability of an mAb recognizing the Fc portion of IgG to bind to IgG1Fc-EGFR (top) or rituximab-EGFR (bottom); Importantly, this particular multi-clonal mAb recognizes regions that are not cleaved by IdeS or IdeZ, thus no cleavage is observed. FIG. 4C quantifies the ability of soluble CD64 (FcγRI) to bind to IgG1Fc-EGFR (top) or rituximab-EGFR (bottom); FIG. 4D quantifies the ability of soluble CD32a (FcγRIIa) to bind to IgG1Fc-EGFR (top) or rituximab-EGFR (bottom); FIG. 4E quantifies the ability of soluble CD16a (FcγRIIIa) to bind to IgG1Fc-EGFR (top) or rituximab-EGFR (bottom).

FIG. 5 illustrates the generation of new lower hinge for IgG1Fc with enhanced binding affinity to CD16α and resistance to cleavage by IdeS and IdeZ. Amino acids (AAs) were added in a stepwise fashion to the N-terminus of IgG1 Δ16 (SEQ ID NO: 16), which does not bind CD16α. Clones acquiring CD16 α binding were selected for by sequentially attaching more amino acids step by step to increase binding affinity.

FIG. 6A show binding affinity of various contracts of human IgG1FcΔ16 was fused with EGFR transmembrane helix domain and displayed as a type 1 membrane protein on the CHO cell surface. FIG. 6B shows individual panels of all the positive clones as more AAs were added. Second column from left shows (from top to bottom) SEQ ID NOs: 648, 655, 656, 657, 658, 659, and 660. Third column from left shows (from top to bottom) SEQ ID NOs: 647, 645, 644, 646, 643, 642, 641, 640, 639, and 638. Fourth column from left shows (from top to bottom) SEQ ID NOs: 545, 546, 637, and 636.

FIGS. 11A-B show representative data comparing WT rituximab and "EETCWDW ritmixmab" (SEQ ID NO:545) in natural killer (NK) cell activation, and FIG. 11C shows representative data comparing WT rituximab and "EETCWDW rituximab" (SEQ ID NO:545) in NK cell depletion of B cells. These experiments were conducted in vitro in whole human blood over the course of 10 hours, without ("control") or with IdeZ ("IdeZ"). IdeZ removes endogenous IgG binding to FcγRs such as CD16α on innate immune cells such as NK cells, monocytes and granulocytes.

DETAILED DESCRIPTION

I. Definitions

Figure 1:
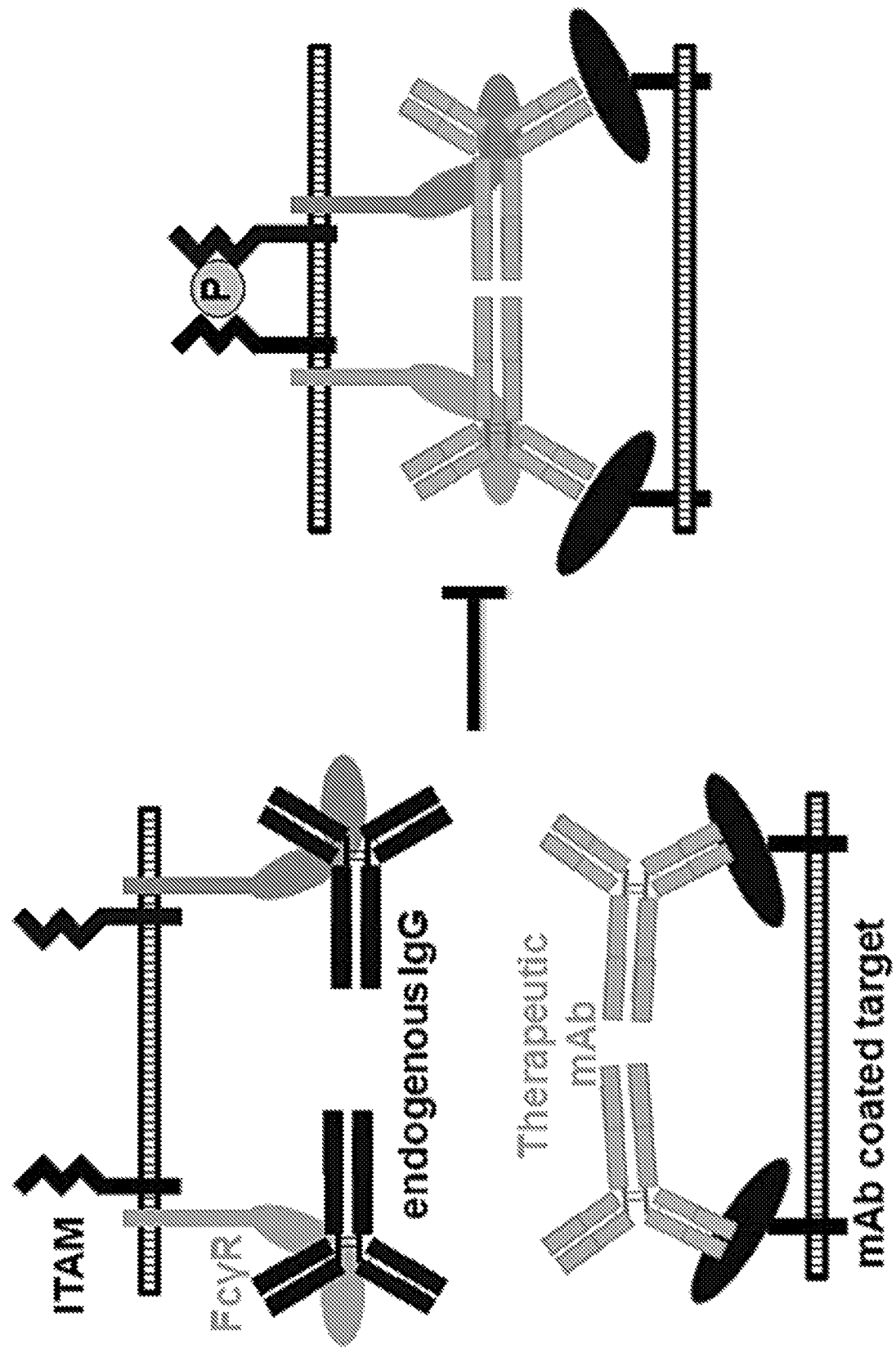
FIG. 1 schematically illustrates that human immune cells are naturally coated with endogenous IgG, which prevents interactions between a therapeutic mAb and FcγRs expressed on the surface of the human immune cells. This thereby limits the binding of therapeutic mAb to FcγRs thus limits the efficacy of the therapeutic mAb.

Unless defined otherwise, all technical and scientific terms used herein have the same meaning as commonly understood by someone of ordinary skill in the art to which this technology belongs. In this specification and in the claims that follow, reference will be made to a number of terms that shall be defined to have the following meanings:

As used herein, the term "antibody" is used in accordance with its plain ordinary meanings and refers to a polypeptide encoded by an immunoglobulin gene or functional fragments thereof that specifically binds and recognizes an antigen. The recognized immunoglobulin genes include the kappa, lambda, alpha, gamma, delta, epsilon, and mu constant region genes, as well as the myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively. The term "antibody" also includes bivalent or bispecific molecules, diabodies, triabodies, and tetrabodies.

As used herein, the terms "specifically (or selectively) binds" or "specifically (or selectively) immunoreactive with," when referring to a protein or peptide, are used in accordance with their plain ordinary meanings and refer to a binding reaction that is determinative of the presence of the protein, often in a heterogeneous population of proteins and other biologics. Thus, under designated immunoassay conditions, the specified antibodies bind to a particular protein at least two times the background and more typically more than 10 to 100 times background. Specific binding to an antibody under such conditions requires an antibody that is selected for its specificity for a particular protein. For example, polyclonal antibodies can be selected to obtain only a subset of antibodies that are specifically immunoreactive with the selected antigen and not with other proteins. This selection may be achieved by subtracting out antibodies that cross-react with other molecules. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Using Antibodies, A Laboratory Manual (1998) for a description of immunoassay formats and conditions that can be used to determine specific immunoreactivity).

An example of an immunoglobulin (antibody) structural unit comprises a tetramer. Each tetramer is composed of two identical pairs of polypeptide chains, each pair having one "light" (about 25 kDa) and one "heavy" chain (about 50-70 kDa). The N-terminus of each chain defines a variable region of about 100 to 110 or more amino acids primarily responsible for antigen recognition. The terms "variable heavy chain," "$V_H$," or "VH" refer to the variable region of an immunoglobulin heavy chain, including an Fv, scFv, dsFv or Fab; while the terms "variable light chain," "$V_L$," or "VL" refer to the variable region of an immunoglobulin light chain, including of an Fv, scFv, dsFv or Fab.

Examples of antibody functional fragments include, but are not limited to, complete antibody molecules, antibody fragments, such as Fv, single chain Fv (scFv), complementarity determining regions (CDRs), $V_L$ (light chain variable region), $V_H$ (heavy chain variable region), Fab, F(ab)2' and any combination of those or any other functional portion of an immunoglobulin peptide capable of binding to target antigen (see, e.g., FUNDAMENTAL IMMUNOLOGY (Paul ed., 4th ed. 2001). As appreciated by one of skill in the art, various antibody fragments can be obtained by a variety of methods, for example, digestion of an intact antibody with an enzyme, such as pepsin; or de novo synthesis. Antibody fragments are often synthesized de novo either chemically or by using recombinant DNA methodology. Thus, the term antibody, as used herein, includes antibody fragments either produced by the modification of whole antibodies, or those synthesized de novo using recombinant DNA methodologies (e.g., single chain Fv) or those identified using phage display libraries.

As used herein, the term "chimeric antibody" is used in accordance with its plain ordinary meaning and refers to an antibody molecule in which (a) the constant region, or a portion thereof, is altered, replaced or exchanged so that the antigen binding site (variable region) is linked to a constant region of a different or altered class, effector function and/or species, or an entirely different molecule which confers new properties to the chimeric antibody, e.g., an enzyme, toxin, hormone, growth factor, drug, etc.; or (b) the variable region, or a portion thereof, is altered, replaced or exchanged with a variable region having a different or altered antigen specificity. The preferred antibodies of, and for use according to the invention include humanized and/or chimeric monoclonal antibodies.

As used herein, the term "therapeutic antibody" is used in accordance with its plain ordinary meaning and refers to an antibody useful in treating a disease. A therapeutic antibody can activate, repress, or alter endogenous immune responses to specific cells or molecules. In embodiments, a therapeutic antibody is an antibody useful in treating cancer, inflammatory, and/or autoimmune disease. In embodiments, a therapeutic antibody is an antibody useful in treating cancer. In embodiments, the therapeutic antibody is an IgG antibody and such embodiments may be referred to as a therapeutic IgG or therapeutic IgG antibody. Examples of a therapeutic antibody include Abciximab, Adalimumab, Alemtuzumab, Alemtuzumab, Alirocumab, Arcitumomab, Atezolizumab, Avelumab, Basiliximab, Belimumab, Besilesomab, Bevacizumab, Bezlotoxumab, Brentuximab, Brodalumab, Canakinumab, Capromab, Catumaxomab, Certolizumab pegol, Cetuximab, Daratumumab, Denosumab, Dinutuximab, Dupilumab, Durvalumab, Eculizumab, Efalizumab, Elotuzumab, Fanolesomab, Gemtuzumab ozogamicin, Golimumab, Ibritumomab tiuxetan, Idarucizumab, Imiciromab, Infliximab, Ipilimumab, Mepolizumab, Muromonab-CD3, Natalizumab, Necitumumab, Nivolumab, Nofetumomab, Obiltoxaximab, Obinutuzumab, Ocrelizumab, Ofatumumab, Olaratumab, Omalizumab, Palivizumab, Panitumumab, Pembrolizumab, Pertuzumab, Ramucirumab, Ranibizumab, Raxibacumab, Reslizumab, Rituximab, Satumomab, Secukinumab, Siltuximab, Sulesomab, Tocilizumab, Tositumomab, Trastuzumab, Trastuzumab emtansine, Ustekinumab, Vedolizumab, Volocumab, and Votumumab.

As used herein, the term "Rituximab" is used in accordance with its plain ordinary meaning and refers to a monoclonal antibody therapeutic invented by Genentech, Inc. that targets the CD20 antigen expressed on the surface of B-cells. It is also known by the brand names Rituxan (Genentech, Inc.), Rituxan Sc (Hoffman-La Roche, Inc.), and biosimilar Truixma (Celltiron, Cephalon, Inc.). The hinge region is denoted by Kabat numbering as positions 246-252 and alternatively as positions 233-239 by numbering used, for example, in U.S. Pat. No. 7,317,091.

As used herein, the term "cancer" is used in accordance with its plain ordinary meaning and refers to all types of cancer, neoplasm or malignant tumors found in mammals (e.g. humans), including leukemias, lymphomas, carcinomas and sarcomas. Examples of cancers that may be treated with a compound, composition, or method provided herein include brain cancer, glioma, glioblastoma, neuroblastoma, prostate cancer, colorectal cancer, pancreatic cancer, Medulloblastoma, melanoma, cervical cancer, gastric cancer, ovarian cancer, lung cancer, cancer of the head, Hodgkin's Disease, and Non-Hodgkin's Lymphomas. Additional examples include, thyroid carcinoma, cholangiocarcinoma, pancreatic adenocarcinoma, skin cutaneous melanoma, colon adenocarcinoma, rectum adenocarcinoma, stomach adenocarcinoma, esophageal carcinoma, head and neck squamous cell carcinoma, breast invasive carcinoma, lung adenocarcinoma, lung squamous cell carcinoma, non-small cell lung carcinoma, mesothelioma, multiple myeloma, neuroblastoma, glioma, glioblastoma multiforme, ovarian cancer, rhabdomyosarcoma, primary thrombocytosis, primary macroglobulinemia, primary brain tumors, malignant pancreatic insulanoma, malignant carcinoid, urinary bladder cancer, premalignant skin lesions, testicular cancer, thyroid cancer, neuroblastoma, esophageal cancer, genitourinary tract cancer, malignant hypercalcemia, endometrial cancer, adrenal cortical cancer, neoplasms of the endocrine or exocrine pancreas, medullary thyroid cancer, medullary thyroid carcinoma, melanoma, colorectal cancer, papillary thyroid cancer, hepatocellular carcinoma, or prostate cancer.

The term "leukemia" is used in accordance with its plain ordinary meaning and refers broadly to progressive, malignant diseases of the blood-forming organs and is generally characterized by a distorted proliferation and development of leukocytes and their precursors in the blood and bone marrow. Leukemia is generally clinically classified on the basis of (1) the duration and character of the disease-acute or chronic; (2) the type of cell involved; myeloid (myelogenous), lymphoid (lymphogenous), or monocytic; and (3) the increase or non-increase in the number abnormal cells in the blood-leukemic or aleukemic (subleukemic). Examples of leukemias that may be treated with a compound or method provided herein include, for example, acute nonlymphocytic leukemia, chronic lymphocytic leukemia, acute granulocytic leukemia, chronic granulocytic leukemia, acute promyelocytic leukemia, adult T-cell leukemia, aleukemic leukemia, a leukocythemic leukemia, basophylic leukemia, blast cell leukemia, bovine leukemia, chronic myelocytic leukemia, leukemia cutis, embryonal leukemia, eosinophilic leukemia, Gross' leukemia, hairy-cell leukemia, hemoblastic leukemia, hemocytoblastic leukemia, histiocytic leukemia, stem cell leukemia, acute monocytic leukemia, leukopenic leukemia, lymphatic leukemia, lymphoblastic leukemia, lymphocytic leukemia, lymphogenous leukemia, lymphoid leukemia, lymphosarcoma cell leukemia, mast cell leukemia, megakaryocytic leukemia, micromyeloblastic leukemia, monocytic leukemia, myeloblastic leukemia, myelocytic leukemia, myeloid granulocytic leukemia, myelomonocytic leukemia, Naegeli leukemia, plasma cell leukemia, multiple myeloma, plasmacytic leukemia, promyelocytic leukemia, Rieder cell leukemia, Schilling's leukemia, stem cell leukemia, subleukemic leukemia, or undifferentiated cell leukemia.

The term "patient" or "subject in need thereof" is used in accordance with its plain ordinary meaning and refers to a living organism suffering from or prone to a disease or condition that can be treated by administration of a composition, compound, or method as provided herein. Non-limiting examples include humans, other mammals, bovines, rats, mice, dogs, monkeys, goat, sheep, cows, deer, and other non-mammalian animals. In some embodiments, a patient is human. In embodiments, the subject has, had, or is suspected of having cancer.

As used herein, the terms "control" or "control experiment" are used in accordance with its plain ordinary meaning and refer to an experiment in which the subjects or reagents of the experiment are treated as in a parallel experiment except for omission of a procedure, reagent, or variable of the experiment. In some instances, the control is used as a standard of comparison in evaluating experimental effects. In some embodiments, a control is the measurement of the activity of a protein in the absence of a compound as described herein (including embodiments and examples).

As used herein, the terms "treating" or "treatment" are used in accordance with its plain ordinary meaning and refer to to any indicia of success in the therapy or amelioration of an injury, disease, pathology or condition, including any objective or subjective parameter such as abatement; remission; diminishing of symptoms or making the injury, pathology or condition more tolerable to the patient; slowing in the rate of degeneration or decline; making the final point of degeneration less debilitating; improving a patient's physical or mental well-being. The treatment or amelioration of symptoms can be based on objective or subjective parameters; including the results of a physical examination, neuropsychiatric exams, and/or a psychiatric evaluation. The term "treating" and conjugations thereof, may include prevention of an injury, pathology, condition, or disease. In embodiments, treating includes preventing. In embodiments, treating does not include preventing.

As used herein, the term "percentage of sequence identity" is used in accordance with its plain ordinary meaning and is determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

As used herein, the terms "identical" or percent "identity," are used in accordance with their plain ordinary meanings and in the context of two or more nucleic acids or polypeptide sequences, refer to two or more sequences or subsequences that are the same or have a specified percentage of amino acid residues or nucleotides that are the same (i.e., about 60% identity, preferably 65%, 70%, 75%, 80%, 85%, 90%, 91%, 92%, 93%, 94%, 95%, 96%, 97%, 98%, 99%, or higher identity over a specified region, when compared and aligned for maximum correspondence over a comparison window or designated region) as measured using a BLAST or BLAST 2.0 sequence comparison algorithms with default parameters described below, or by manual alignment and visual inspection (see, e.g., NCBI web site available on the World Wide Web at the ncbi.nlm.gov/BLAST website or the like). Such sequences are then said to be "substantially identical." This definition also refers to, or may be applied to, the compliment of a test sequence. The definition also includes sequences that have deletions and/or additions, as well as those that have substitutions. As described below, the preferred algorithms can account for gaps and the like. Preferably, identity exists over a region that is at least about 25 amino acids or nucleotides in length, or more preferably over a region that is 50-100 amino acids or nucleotides in length.

As used herein, the terms "affinity selection" or "affinity maturation" are used in accordance with their plain ordinary meanings and refer to a process in which an antibody is evolved from a reference antibody, typically by mutation of one or more amino acid residues, to have increased activity for a target antigen than a corresponding form of the reference antibody has for the same target antigen. Hence, the evolved antibody is optimized compared to the reference antibody. Selection of refined antibodies can be achieved through various biophysical and in vitro methods.

As used herein, the term "fusion protein" is used in accordance with its plain ordinary meaning and refers to a covalently-linked polypeptide chain derived from two or more different proteins or genes of origin.

As used herein, the terms "CD16 protein" or "CD16" or "FcγRIII" or "Fc gamma receptor III" are used in accordance with their plain ordinary meanings and refer to any of the recombinant or naturally-occurring forms of receptor CD16 or Cluster of Differentiation 16 (CD16), or variants or homologs thereof that maintain CD16 activity (e.g. within at least 50%, 80%, 90%, 95%, 96%, 97%, 98%, 99% or 100% activity compared to CD16). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring CD16 protein. In embodiments, the CD16 protein is substantially identical to the protein identified by the UniProt reference number P08637 or a variant or homolog having substantial identity thereto. In embodiments, the CD16 protein is substantially identical to the protein identified by the UniProt reference number Q9ULV2 or a variant or homolog having substantial identity thereto. CD16 is a receptor for Fc region of IgG, and mediates antibody-dependent cellular cytotoxicity (ADCC).

As used herein, the terms "CD32 protein" or "CD32" or "FcγRII" or "Fc gamma receptor II" are used in accordance with their plain ordinary meanings and refer to any of the recombinant or naturally-occurring forms of receptor CD32 or Cluster of Differentiation 32 (CD32), or variants or homologs thereof that maintain CD32 activity (e.g. within at least 50%, 80%, 90%, 95%, 96%, 97%, 98%, 99% or 100% activity compared to CD32). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring CD32 protein. In embodiments, the CD32 protein is substantially identical to the protein identified by the UniProt reference number P12318 or a variant or homolog having substantial identity thereto. In embodiments, the CD32 protein is substantially identical to the protein identified by the UniProt reference number P31994 or a variant or homolog having substantial identity thereto. In embodiments, the CD32 protein is substantially identical to the protein identified by the UniProt reference number P31995 or a variant or homolog having substantial identity thereto. CD32 is a receptor for the Fc region of complexed or aggregated IgG, mediates B-cell activation, phagocytosis, and endocytosis of immune complexes.

As used herein, the terms "CD64 protein" or "CD64" or "FcγRI" or "Fc gamma receptor I" are used in accordance with their plain ordinary meanings and refer to any of the recombinant or naturally-occurring forms of receptor CD64 or Cluster of Differentiation 64 (CD64), or variants or homologs thereof that maintain CD64 activity (e.g. within at least 50%, 80%, 90%, 95%, 96%, 97%, 98%, 99% or 100% activity compared to CD64). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring CD64 protein. In embodiments, the CD64 protein is substantially identical to the protein identified by the UniProt reference number P12314 or a variant or homolog having substantial identity thereto. In embodiments, the CD64 protein is substantially identical to the protein identified by the UniProt reference number Q92637 or a variant or homolog having substantial identity thereto. In embodiments, the CD64 protein is substantially identical to the protein identified by the UniProt reference number P30273 or a variant or homolog having substantial identity thereto. CD64 is a high-affinity receptor that binds non-complexed immunoglobulins.

As used herein, the terms "EGFR protein" or "EGFR" or "HER1" are used in accordance with their plain ordinary meanings and refer to any of the recombinant or naturally-occurring forms of epidermal growth factor receptor (EGFR) also known as ErbB-1 or HER1 in humans, or variants or homologs thereof that maintain EGFR activity (e.g. within at least 50%, 80%, 90%, 95%, 96%, 97%, 98%, 99% or 100% activity compared to EGFR). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring EGFR protein. In embodiments, the EGFR protein is substantially identical to the protein identified by the UniProt reference number P00533 or a variant or homolog having substantial identity thereto. EGFR is a receptor tyrosine kinase.

As used herein, the terms "PDGFR protein" or "PDGFR" are used in accordance with their plain ordinary meanings and refer to any of the recombinant or naturally-occurring forms of platelet-derived growth factor receptor (PDGFR) or variants or homologs thereof that maintain PDGFR activity (e.g. within at least 50%, 80%, 90%, 95%, 96%, 97%, 98%, 99% or 100% activity compared to PDGFR). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring EGFR protein. In embodiments, the PDGFR protein is substantially identical to the protein PDGFR-alpha, identified by the UniProt reference number P16234 or a variant or homolog having substantial identity thereto. In embodiments, the PDGFR protein is substantially identical to the protein PDGFR-beta identified by the UniProt reference number P09619 or a variant or homolog having substantial identity thereto. PDGFR is a receptor tyrosine kinase.

As used herein, the terms "HER-2 protein" or "HER2" or "human epidermal growth factor receptor 2" or "Receptor Tyrosine-Protein Kinase ERBB-2" or "ERBB2" or "proto-oncogene Neu" or "CD340" or "Cluster of Differentiation 340" are used in accordance with their plain ordinary meanings and refer to any of the recombinant or naturally-occurring forms of human epidermal growth factor receptor 2 (HER2) or variants or homologs thereof that maintain HER2 activity (e.g. within at least 50%, 80%, 90%, 95%, 96%, 97%, 98%, 99% or 100% activity compared to HER2). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring HER2 protein. In embodiments, the HER2 protein is substantially identical to the protein identified by the UniProt reference number P04626 or a variant or homolog having substantial identity thereto. HER2 is a receptor tyrosine kinase.

As used herein, the terms "HER-3 protein" or "HER3" or "human epidermal growth factor receptor 3" or "Receptor Tyrosine-Protein Kinase ERBB-3" or "ERBB3" or "proto-oncogene-like protein c-ErbB-3" are used in accordance with their plain ordinary meanings and refer to any of the recombinant or naturally-occurring forms of human epidermal growth factor receptor 3 (HER3) or variants or homologs thereof that maintain HER3 activity (e.g. within at least 50%, 80%, 90%, 95%, 96%, 97%, 98%, 99% or 100% activity compared to HER3). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring HER3 protein. In embodiments, the HER3 protein is substantially identical to the protein identified by the UniProt reference number P21860 or a variant or homolog having substantial identity thereto. HER3 is a receptor tyrosine kinase.

As used herein, the terms "HER-4 protein" or "HER4" or "human epidermal growth factor receptor 4" or "Receptor Tyrosine-Protein Kinase ERBB-4" or "ERBB4" or "proto-oncogene-like protein c-ErbB-4" are used in accordance with their plain ordinary meanings and refer to any of the recombinant or naturally-occurring forms of human epidermal growth factor receptor 4 (HER4) or variants or homologs thereof that maintain HER4 activity (e.g. within at least 50%, 80%, 90%, 95%, 96%, 97%, 98%, 99% or 100% activity compared to HER4). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring HER4 protein. In embodiments, the HER4 protein is substantially identical to the protein identified by the UniProt reference number Q15303 or a variant or homolog having substantial identity thereto. HER4 is a receptor tyrosine kinase.

As used herein, the terms "FGFR-1 protein" or "FGFR1" or "fibroblast growth factor receptor 1" or "basic fibroblast growth factor receptor" or "N-sam" or "proto-oncogene c-Fgr" are used in accordance with their plain ordinary meanings and refer to any of the recombinant or naturally-occurring forms of fibroblast growth factor receptor 1 (FGFR1) or variants or homologs thereof that maintain FGFR1 activity (e.g. within at least 50%, 80%, 90%, 95%, 96%, 97%, 98%, 99% or 100% activity compared to FGFR1). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring FGFR1 protein. In embodiments, the FGFR1 protein is substantially identical to the protein identified by the UniProt reference number P11362 or a variant or homolog having substantial identity thereto. FGFR1 is a receptor tyrosine kinase.

As used herein, the terms "FGFR-2 protein" or "FGFR2" or "fibroblast growth factor receptor 2" or "keratinocyte growth factor receptor" or "K-sam" are used in accordance with their plain ordinary meanings and refer to any of the recombinant or naturally-occurring forms of fibroblast growth factor receptor 2 (FGFR2) or variants or homologs thereof that maintain FGFR2 activity (e.g. within at least 50%, 80%, 90%, 95%, 96%, 97%, 98%, 99% or 100% activity compared to FGFR2). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring FGFR2 protein. In embodiments, the FGFR2 protein is substantially identical to the protein identified by the UniProt reference number P21802 or a variant or homolog having substantial identity thereto. FGFR2 is a receptor tyrosine kinase.

As used herein, the terms "FGFR-3 protein" or "FGFR3" or "fibroblast growth factor receptor 3" are used in accordance with their plain ordinary meanings and refer to any of the recombinant or naturally-occurring forms of fibroblast growth factor receptor 3 (FGFR3) or variants or homologs thereof that maintain FGFR3 activity (e.g. within at least 50%, 80%, 90%, 95%, 96%, 97%, 98%, 99% or 100% activity compared to FGFR3). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring FGFR3 protein. In embodiments, the FGFR3 protein is substantially identical to the protein identified by the UniProt reference number P22607 or a variant or homolog having substantial identity thereto. FGFR3 is a receptor tyrosine kinase.

As used herein, the terms "FGFR-4 protein" or "FGFR4" or "fibroblast growth factor receptor 4" are used in accordance with their plain ordinary meanings and refer to any of the recombinant or naturally-occurring forms of fibroblast growth factor receptor 4 (FGFR4) or variants or homologs thereof that maintain FGFR4 activity (e.g. within at least 50%, 80%, 90%, 95%, 96%, 97%, 98%, 99% or 100% activity compared to FGFR4). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring FGFR4 protein. In embodiments, the FGFR4 protein is substantially identical to the protein identified by the UniProt reference number P22455 or a variant or homolog having substantial identity thereto. FGFR4 is a receptor tyrosine kinase.

As used herein, the terms "VEGFR-1 protein" or "VEGFR1" or "vascular endothelial growth factor receptor 1" are used in accordance with their plain ordinary meanings and refer to any of the recombinant or naturally-occurring forms of vascular endothelial growth factor receptor 1 (VEGFR1) or variants or homologs thereof that maintain VEGFR1 activity (e.g. within at least 50%, 80%, 90%, 95%, 96%, 97%, 98%, 99% or 100% activity compared to VEGFR1). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring VEGFR1 protein. In embodiments, the VEGFR1 protein is substantially identical to the protein identified by the UniProt reference number P17948 or a variant or homolog having substantial identity thereto. VEGFR1 is a receptor tyrosine kinase.

As used herein, the terms "VEGFR-2 protein" or "VEGFR2" or "vascular endothelial growth factor receptor 2" are used in accordance with their plain ordinary meanings and refer to any of the recombinant or naturally-occurring forms of vascular endothelial growth factor receptor 1 (VEGFR2) or variants or homologs thereof that maintain VEGFR2 activity (e.g. within at least 50%, 80%, 90%, 95%, 96%, 97%, 98%, 99% or 100% activity compared to VEGFR2). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring VEGFR2 protein. In embodiments, the VEGFR2 protein is substantially identical to the protein identified by the UniProt reference number P35968 or a variant or homolog having substantial identity thereto. VEGFR2 is a receptor tyrosine kinase.

As used herein, the terms "VEGFR-3 protein" or "VEGFR3" or "vascular endothelial growth factor receptor 3" are used in accordance with their plain ordinary meanings and refer to any of the recombinant or naturally-occurring forms of vascular endothelial growth factor receptor 1 (VEGFR3) or variants or homologs thereof that maintain VEGFR3 activity (e.g. within at least 50%, 80%, 90%, 95%, 96%, 97%, 98%, 99% or 100% activity compared to VEGFR3). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring VEGFR3 protein. In embodiments, the VEGFR3 protein is substantially identical to the protein identified by the UniProt reference number P35916 or a variant or homolog having substantial identity thereto. VEGFR3 is a receptor tyrosine kinase.

As used herein, the terms "NTRK1 protein" or "NTRK1" or "Trk-A" or "high affinity nerve growth factor receptor" or "neurotrophic tyrosine kinase receptor type 1" or "tropomyosin-related kinase A" are used in accordance with their plain ordinary meanings and refer to any of the recombinant or naturally-occurring forms of high affinity nerve growth factor receptor (NTRK1) or variants or homologs thereof that maintain NTRK1 activity (e.g. within at least 50%, 80%, 90%, 95%, 96%, 97%, 98%, 99% or 100% activity compared to NTRK1). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring NTKR1 protein. In embodiments, the NTKR1 protein is substantially identical to the protein identified by the UniProt reference number P04629 or a variant or homolog having substantial identity thereto. NTKR1 is a receptor tyrosine kinase.

As used herein, the terms "NTRK2 protein" or "NTRK2" or "Trk-B" or "BDNF/NT-3 growth factors receptor" or "brain derived neurotrophic growth factor receptor" are used in accordance with their plain ordinary meanings and refer to any of the recombinant or naturally-occurring forms of oncogene BDNF/NT-3 growth factors receptor (NTRK2) or variants or homologs thereof that maintain NTRK2 activity (e.g. within at least 50%, 80%, 90%, 95%, 96%, 97%, 98%, 99% or 100% activity compared to NTRK2). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring NTKR2 protein. In embodiments, the NTKR2 protein is substantially identical to the protein identified by the UniProt reference number Q16620 or a variant or homolog having substantial identity thereto. NTKR2 is a receptor tyrosine kinase.

As used herein, the terms "NTRK3 protein" or "NTRK3" or "Trk-C" or "NT-3 growth factor receptor" are used in accordance with their plain ordinary meanings and refer to any of the recombinant or naturally-occurring forms of NT-3 growth factor receptor (NTRK3) or variants or homologs thereof that maintain NTRK3 activity (e.g. within at least 50%, 80%, 90%, 95%, 96%, 97%, 98%, 99% or 100% activity compared to NTRK3). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring NTKR3 protein. In embodiments, the NTKR3 protein is substantially identical to the protein identified by the UniProt reference number Q16628 or a variant or homolog having substantial identity thereto. NTKR3 is a receptor tyrosine kinase.

As used herein, the term "IGF1R protein" or "IGF1R" or "insulin-like growth factor receptor" are used in accordance with their plain ordinary meanings and refer to any of the recombinant or naturally-occurring forms of insulin-like growth factor receptor (IGF1R) or variants or homologs thereof that maintain IGF1R activity (e.g. within at least 50%, 80%, 90%, 95%, 96%, 97%, 98%, 99% or 100% activity compared to IGF1R). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring IGF1R protein. In embodiments, the IGF1R protein is substantially identical to the protein identified by the UniProt reference number P08069 or a variant or homolog having substantial identity thereto. IGF1R is a receptor tyrosine kinase.

As used herein, the terms "glutamyl endopeptidase V8" or "GluV8" or "SspA" or "endopeptidase Glu-C" or "V8 protease" or "staphylococcal serine protease" are used in accordance with their plain and ordinary meanings and refer to any of the recombinant or naturally-occurring forms of the SspA protein or variants or homologs thereof that maintain SspA activity (e.g. within at least 50%, 80%, 90%, 95%, 96%, 97%, 98%, 99% or 100% activity compared to SspA). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring SspA polypeptide. In embodiments, SspA is the protein as identified by the UniProt reference number P0C1U8 or a variant or homolog having substantial identity thereto. SspA is a serine protease that preferentially cleaves peptide bonds on the carboxyl-terminal side of glutamate and aspartate.

As used herein, the terms "immunoglobulin domain" or "Ig-domain" are used in accordance with their plain and ordinary meanings and refer to any of the recombinant or naturally-occurring forms of the Ig-domain or variants or homologs thereof that maintain the Ig-domain fold or three-dimensional structure. The Ig-domain belongs to a family of protein folds that consist of a 2-layer sandwich of 7-9 antiparallel beta-strands arranged in two beta-sheets with a Greek-key topology. The folding pattern typically consists of (N-terminal beta-hairpin-in sheet 1)-(beta-haripin-in sheet 2)-(beta-strand in sheet 1)-(C-terminal beta-hairpin in sheet 2) linkages. Immunoglobulin domains are the primary components of antibodies, and a large set of extracellular surface receptors, including receptor tyrosine kinases.

As used herein, the terms "Immunoglobulin G" or "IgG" are used in accordance with their plain and ordinary meanings and refer to any of the recombinant or naturally-occurring forms of the IgG antibody protein or variants or homologs thereof that maintain IgG activity (e.g. within at least 50%, 80%, 90%, 95%, 96%, 97%, 98%, 99% or 100% activity compared to IgG). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring IgG polypeptide. IgG antibodies are composed of four separate chains (two identical light chains and two identical heavy chains) that form a homodimer (via inter-heavy chain disulfide) of heterodimers (one light chain and one heavy chain interchain disulfide) in a canonical Y-shaped quaternary structure. The light chain includes a variable immunoglobulin domain ($V_L$) and a constant immunoglobulin domain ($C_L$). The heavy chain includes one variable immunoglobulin domain (VII) and three constant immunoglobulin domains ($C_H1$, $C_H2$, $C_H3$). The variable domains form the antigen-recognition surface of an IgG antibody. There are four subclasses of IgG, IgG1, IgG2, IgG3, and IgG4 that are different by function. IgG1 mediates thymus-related immune responses against polypeptide and protein antigens. IgG2 mediates immune responses toward polysaccharide or carbohydrate antigens. IgG3 mediates high-affinity responses against proteins and polypeptide antigens. IgG4 has a role in responses associated with food allergies, but its function is largely unknown.

As used herein, the terms "Fc region" or "fragment crystallizable region" are used in accordance with their plain and ordinary meanings and refer to any of the recombinant or naturally-occurring forms of the tail-end region (C-terminal) of an antibody that interacts with a cell-surface receptors known as Fc-receptors. The Fc region is comprised of two heavy chain constant Ig domains in the antibodies IgG, IgA, and IgD, and of three heavy chain constant Ig domains in the antibodies IgE and IgM.

As used herein, the terms "Fab region" or "antigen-binding fragment region" are used in accordance with their plain and ordinary meanings and refer to any of the recombinant or naturally-occurring forms of the tail-end region (N-terminal) of an antibody that contains the antigen recognition and binding site. The Fab region is generally comprised of one variable domain and one constant domain from both the light chain and the heavy chain in the antibodies IgG, IgA, IgD, and IgE, and IgM.

As used herein, the term "hinge region" is used in accordance with its plain and ordinary meaning and refers to any of the recombinant or naturally-occurring forms of the region of an antibody corresponding to the polypeptide sequence that connects the Fab and Fc domains in an antibody, and/or the sequence connecting two single chain variable fragments (scFv) from the light and heavy chains at the N-terminal end of the antibody.

As used herein, the terms "pepsin" or "pepsinogen A" are used in accordance with their plain and ordinary meanings and refer to any of the recombinant or naturally-occurring forms of the pepsin protein or variants or homologs thereof that maintain pepsin activity (e.g. within at least 50%, 80%, 90%, 95%, 96%, 97%, 98%, 99% or 100% activity compared to pepsin). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring pepsin polypeptide. In embodiments, pepsin is the protein as identified by the NCBI sequence reference GI: 387013, homolog or functional fragment thereof.

As used herein, the terms "Cathepsin G" or "Cathepsin G protease" are used in accordance with their plain and ordinary meanings and refer to any of the recombinant or naturally-occurring forms of the Cathepsin G protein or variants or homologs thereof that maintain Cathepsin G activity (e.g. within at least 50%, 80%, 90%, 95%, 96%, 97%, 98%, 99% or 100% activity compared to Cathepsin G). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring Cathepsin G polypeptide. In embodiments, Cathepsin G is the protein as identified by the NCBI sequence reference GI:4503149, homolog or functional fragment thereof.

As used herein, the terms "MMP3" or "MMP3 protease" are used in accordance with their plain and ordinary meanings and refer to any of the recombinant or naturally-occurring forms of the matrix metalloproteinase 3 (MMP3) or variants or homologs thereof that maintain MMP3 activity (e.g. within at least 50%, 80%, 90%, 95%, 96%, 97%, 98%, 99% or 100% activity compared to MMP 3). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring MMP3 polypeptide. In embodiments, MMP3 is the protein as identified by the NCBI sequence reference GI:77567646, homolog or functional fragment thereof.

As used herein, the terms "MMP7" or "MMP7 protease" are used in accordance with their plain and ordinary meanings and refer to any of the recombinant or naturally-occurring forms of the matrix metalloproteinase 7 (MMP7) or variants or homologs thereof that maintain MMP7 activity (e.g. within at least 50%, 80%, 90%, 95%, 96%, 97%, 98%, 99% or 100% activity compared to MMP7). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring MMP7 polypeptide. In embodiments, MMP7 is the protein as identified by the NCBI sequence reference GI:116861, homolog or functional fragment thereof.

As used herein, the terms "MMP12" or "MMP12 protease" are used in accordance with their plain and ordinary meanings and refer to any of the recombinant or naturally-occurring forms of the matrix metalloproteinase 9 (MMP12) or variants or homologs thereof that maintain MMP12 activity (e.g. within at least 50%, 80%, 90%, 95%, 96%, 97%, 98%, 99% or 100% activity compared to MMP12). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring MMP12 polypeptide. In embodiments, MMP12 is the protein as identified by the NCBI sequence reference GI:73858572, homolog or functional fragment thereof.

As used herein, the term "Type I transmembrane protein" is used in accordance with its plain and ordinary meaning and refers to any of the recombinant or naturally-occurring forms of a membrane protein containing a single-pass transmembrane region, where the N-terminus of the protein is located on the extracellular surface.

As used herein, the terms "CHO cell" or "Chinese Hamster Ovary cell" are used in accordance with their plain and ordinary meanings and refer to any epithelial cell lines derived from the ovary of the Chinese hamster.

As used herein, the term "Kabat numbering" or "Kabat position" is used in accordance with its plain and ordinary meaning and refers to a scheme for the numbering of amino acid residues in antibodies based upon variable regions. The scheme is useful when comparing these variable regions between antibodies. In embodiments, the L248 position of the anti-CD20 antibody rituximab correlates with L325 of the antibody sequence according to other numbering systems.

As used herein, the terms "expression vector" or "expression construct" are used in accordance with their plain and ordinary meanings and refer to any of the recombinant or naturally-occurring forms of a bacterial plasmid, bacmid, or virus or variants or homologs thereof that are for the use of expressing a target gene of interest as a protein product. The target of interest can be any gene of interest, including genes that encode for naturally-occurring proteins, any partial or modified variants of naturally-occurring proteins, chimeric proteins, tagged proteins, or de novo designed protein sequences. The expression vector must contain the elements necessary for gene expression, including, but not limited to, a promoter sequence, a ribosome-binding sequence, a start codon, the target of interest sequence, and a stop codon. The expression vector can be modified by any genetic engineering process or technique, including, but not limited to, polymerase chain reaction (PCR), restriction enzyme digest and DNA ligation, Gibson cloning, and CRISPR-related gene editing.

As used herein, the term "surface display" is used in accordance with its plain ordinary meaning and refers to a process where a cellular system is used to express a protein or peptide on the cellular surface. The cellular system can be prokaryotic, or eukaryotic, and can include bacteria, yeast, insect, and mammalian cells. The surface display is achieved by expressing the protein of interest as a fusion protein, which is usually comprised of a partial or full sequence from an endogenously-expressed protein in the cellular system of choice and the protein(s) of interest.

As used herein, the term "cytotoxicity" is used in accordance with its plain ordinary meaning and refers to quality of being toxic to cells.

As used herein, the terms "antibody-dependent cellular cytotoxicity", "ADCC", and "antibody-dependent cell-mediated cytotoxicity" are used in accordance with their plain ordinary meanings and refer to an immune mechanism through which Fc receptor-bearing effector cells can recognize and kill antibody-coated target cells expressing tumor- or pathogen-derived antigens on their surface.

As used herein, the terms "antibody-dependent cellular phagocytosis" and "ADCP" are used in accordance with their plain ordinary meanings and refer to the mechanism by which antibody-opsonized target cells activate the Fc receptors on the surface of macrophages to induce phagocytosis, resulting the ingestion and degradation of the target cell. The macrophage Fc receptors refer to all classes of Fcγ receptors.

As used herein, the terms "adaptive immune response", "acquired immune system", and "specific immune system" are used in accordance with their plain ordinary meanings and refer to a subsystem of the overall immune system that is composed of specialized, systemic cells and processes that eliminate designated targets. The targets are designated by identification via immunological memory. Immunological memory is created when the immune system had previously encountered the immune assault, and retained a record of it.

As used herein, the term "dissociation constant" or "Kd" are used in accordance with their plain ordinary meanings and refer to a specific type of equilibrium constant that measures the propensity of two molecules to be associated with each other. In biochemistry, the dissociation constant is used to describe the relative affinity between a protein and a ligand, for example, an affinity of an antibody for an antigen. In general, the dissociation constant Kd can be described by the equation $$Kd = \frac{[P][L]}{[PL]}$$

Where [P] is the molar concentration of protein, [L] is the molar concentration of ligand, and [PL] is the molar concentration of the protein-ligand complex.

II. Antibodies

In an aspect, provided herein are immunoglobulin G (IgG) antibodies including a Fab region and an Fc region connected through a hinge region, where the hinge region is resistant to cleavage by a protease.

In embodiments, the IgG antibody is selected from an IgG1 antibody, an IgG2 antibody, an IgG3 antibody, and an IgG4 antibody. In embodiments, the IgG antibody is an IgG1 antibody. In embodiments, the IgG antibody is an IgG2 antibody. In embodiments, the IgG antibody is an IgG3 antibody. In embodiments, the IgG antibody is an IgG4 antibody.

In embodiments, the hinge region is resistant to cleavage by a protease. In embodiments, resistance to cleavage by a protease means that a protease is unable to cleave the antibody at an amino acid sequence within the hinge region. In embodiments, resistance to cleavage by a protease is conferred by the amino acid sequence of the hinge region. In embodiments, resistance to cleavage by a protease is relative to a natural or wild type hinge region sequence. In embodiments, the natural or wild type hinge sequence is an amino acid sequencing including ELLGGPS (SEQ ID NO: 544). In embodiments, resistance to cleavage by a protease is relative to a known sequence control. In embodiments, the known sequence is an amino acid sequence including ELLGGPS (SEQ ID NO: 544), which is sensitive to cleavage by an IgG endopeptidase. In embodiments, human IgG2 hinge region comprising the amino acid sequence PVAGPS (SEQ ID NO:680) is resistant to IgG endopeptidase cleavage and may serve as a negative control. In embodiments, resistance to cleavage by a protease is above a certain threshold level using a specific known assay. In embodiments, the assay may be enzymatic digestion of IgG and SDS-PAGE and Coomassie staining to determine molecular weight of digested fragments.

In embodiments, the hinge region includes a protease resistant sequence. In embodiments, the sequence is between amino acid positions 246-252 according to Kabat numbering. In embodiments, the sequence is positions corresponding to Kabat position 246-252. In embodiments, the protease resistant sequence is two or more amino acids in length. In embodiments, the protease resistant sequence is three amino acids in length. In embodiments, the protease resistant sequence is four amino acids in length. In embodiments, the protease resistant sequence is five amino acids in length. In embodiments, the protease resistant sequence is six amino acids in length. In embodiments, the protease resistant sequence is seven amino acids in length. In embodiments, the protease resistant sequence includes the amino acids of SEQ ID NO: 545. In embodiments, the protease resistant sequence includes the amino acids of SEQ ID NO: 546. In embodiments, the protease resistant sequence includes the amino acids of SEQ ID NO: 547.

In embodiments, the Fc region of an IgG antibody described herein has a dissociation constant of about $1 \times 10^{-5}$ M to about $1 \times 10^{-13}$ M to one or more of CD32 (FcγRII), CD16 (FcγRIII), and CD64 (FcγRI). In embodiments, the Fc region has a dissociation constant of about $1 \times 10^{-5}$ M to about $1 \times 10^{-12}$ M, about $1 \times 10^{-5}$ M to about $1 \times 10^{-11}$ M, about $1 \times 10^{-5}$ M to about $1 \times 10^{-10}$ M, about $1 \times 10^{-5}$M to about $1 \times 10^{-9}$ M, about $1 \times 10^{-5}$ M to about $1 \times 10^{-8}$ M, about $1 \times 10^{-5}$ M to about $1 \times 10^{-7}$ M, about $1 \times 10^{-5}$ M to about $1 \times 10^{-6}$ M, about $1 \times 10^{-6}$ M to about $1 \times 10^{-13}$ M, about $1 \times 10^{-6}$ M to about $1 \times 10^{-12}$ M, about $1 \times 10^{-6}$ M to about $1 \times 10^{-11}$ M, about $1 \times 10^{-6}$ M to about $1 \times 10^{-10}$ M, about $1 \times 10^{-6}$ M to about $1 \times 10^{-9}$ M, about $1 \times 10^{-6}$ M to about $1 \times 10^{-8}$ M, about $1 \times 10^{-6}$ M to about $1 \times 10^{-7}$ M, about $1 \times 10^{-7}$M to about $1 \times 10^{-13}$ M, about $1 \times 10^{-7}$M to about $1 \times 10^{-12}$ M, about $1 \times 10^{-7}$M to about $1 \times 10^{-11}$ M, about $1 \times 10^{-7}$M to about $1 \times 10^{-10}$ M, about $1 \times 10^{-7}$ M to about $1 \times 10^{-9}$ M, about $1 \times 10^{-7}$M to about $1 \times 10^{-8}$ M, about $1 \times 10^{-8}$ M to about $1 \times 10^{-13}$ M, about $1 \times 10^{-8}$ M to about $1 \times 10^{-12}$ M, about $1 \times 10^{-8}$ M to about $1 \times 10^{-11}$ M, about $1 \times 10^{-8}$ M to about $1 \times 10^{-10}$ M, about $1 \times 10^{-8}$ M to about $1 \times 10^{-9}$ M, about $1 \times 10^{-9}$M to about $1 \times 10^{-13}$ M, about $1 \times 10^{-9}$M to about $1 \times 10^{-12}$ M, about $1 \times 10^{-9}$M to about $1 \times 10^{-11}$ M, about $1 \times 10^{-9}$M to about $1 \times 10^{-10}$ M, about $1 \times 10^{-10}$ M to about $1 \times 10^{-13}$ M, about $1 \times 10^{-10}$ M to about $1 \times 10^{-12}$ M, about $1 \times 10^{-10}$ M to about $1 \times 10^{-11}$ M, about $1 \times 10^{-11}$ M to about $1 \times 10^{-13}$ M, about $1 \times 10^{-11}$ M to about $1 \times 10^{-12}$ M, or about $1 \times 10^{-12}$ M to about $1 \times 10^{-13}$ M to one or more of CD32 (FcγRII), CD16 (FcγRIII), and CD64 (FcγRI). In embodiments, the Fc region of an IgG antibody described herein has a dissociation constant of about $1 \times 10^{-5}$ M, about $1 \times 10^{-6}$M, about $1 \times 10^{-7}$M, about $1 \times 10^{-8}$ M, about $1 \times 10^{-9}$M, about $1 \times 10^{-10}$M, about $1 \times 10^{-11}$M, about $1 \times 10^{-12}$M, or about $1 \times 10^{-13}$ M to one or more of CD32 (FcγRII), CD16 (FcγRIII), and CD64 (FcγRI).

In embodiments, the Fc region of the IgG antibody has a dissociation constant of about $1 \times 10^{-5}$ M to about $1 \times 10^{-13}$ M to CD32 (FcγRII). In embodiments, the Fc region has a dissociation constant of about $1 \times 10^{-5}$ M to about $1 \times 10^{-12}$ M, about $1 \times 10^{-5}$ M to about $1 \times 10^{-11}$ M, about $1 \times 10^{-5}$ M to about $1 \times 10^{-10}$ M, about $1 \times 10^{-5}$ M to about $1 \times 10^{-9}$ M, about $1 \times 10^{-5}$ M to about $1 \times 10^{-8}$ M, about $1 \times 10^{-5}$ M to about $1 \times 10^{-7}$ M, about $1 \times 10^{-5}$ M to about $1 \times 10^{-6}$ M, about $1 \times 10^{-6}$ M to about $1 \times 10^{-13}$ M, about $1 \times 10^{-6}$ M to about $1 \times 10^{-12}$ M, about $1 \times 10^{-6}$ M to about $1 \times 10^{-11}$ M, about $1 \times 10^{-6}$ M to about $1 \times 10^{-10}$ M, about $1 \times 10^{-6}$ M to about $1 \times 10^{-9}$ M, about $1 \times 10^{-6}$ M to about $1 \times 10^{-8}$ M, about $1 \times 10^{-6}$M to about $1 \times 10^{-7}$ M, about $1 \times 10^{-7}$M to about $1 \times 10^{-13}$ M, about $1 \times 10^{-7}$ M to about $1 \times 10^{-12}$ M, about $1 \times 10^{-7}$M to about $1 \times 10^{-11}$ M, about $1 \times 10^{-7}$M to about $1 \times 10^{-10}$ M, about $1 \times 10^{-7}$M to about $1 \times 10^{-9}$ M, about $1 \times 10^{-7}$M to about $1 \times 10^{-8}$ M, about $1 \times 10^{-8}$ M to about $1 \times 10^{-13}$ M, about $1 \times 10^{-8}$ M to about $1 \times 10^{-12}$ M, about $1 \times 10^{-8}$ M to about $1 \times 10^{-11}$ M, about $1 \times 10^{-8}$ M to about $1 \times 10^{-10}$ M, about $1 \times 10^{-8}$ M to about $1 \times 10^{-9}$ M, about $1 \times 10^{-9}$M to about $1 \times 10^{-13}$ M, about $1 \times 10^{-9}$M to about $1 \times 10^{-12}$ M, about $1 \times 10^{-9}$M to about $1 \times 10^{-11}$ M, about $1 \times 10^{-9}$M to about $1 \times 10^{-10}$ M, about $1 \times 10^{-10}$ M to about $1 \times 10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to CD32 (FcγRII). In embodiments, the Fc region of an IgG antibody described herein has a dissociation constant of about $1\times10^{-5}$ M, about $1\times10^{-6}$ M, about $1\times10^{-7}$ M, about $1\times10^{-8}$ M, about $1\times10^{-9}$ M, about $1\times10^{-10}$ M, about $1\times10^{-11}$ M, about $1\times10^{-12}$ M, or about $1\times10^{-13}$ M to CD32 (FcγRII). In embodiments, the Fc region of an IgG antibody described herein has a dissociation constant of about $1\times10^{-5}$ M to CD32 (FcγRII). In embodiments, the Fc region of an IgG antibody described herein has a dissociation constant of about $1\times10^{-6}$ M to CD32 (FcγRII). In embodiments, the Fc region of an IgG antibody described herein has a dissociation constant of about $1\times10^{-7}$ M to CD32 (FcγRII). In embodiments, the Fc region of an IgG antibody described herein has a dissociation constant of about $1\times10^{-8}$ M to CD32 (FcγRII). In embodiments, the Fc region of an IgG antibody described herein has a dissociation constant of about $1\times10^{-9}$ M to CD32 (FcγRII). In embodiments, the Fc region of an IgG antibody described herein has a dissociation constant of about $1\times10^{-10}$ M to CD32 (FcγRII). In embodiments, the Fc region of an IgG antibody described herein has a dissociation constant of about $1\times10^{-11}$ M to CD32 (FcγRII). In embodiments, the Fc region of an IgG antibody described herein has a dissociation constant of about $1\times10^{-12}$ M to CD32 (FcγRII). In embodiments, the Fc region of an IgG antibody described herein has a dissociation constant of about $1\times10^{-13}$ M to CD32 (FcγRII).

In embodiments, the Fc region of the IgG antibody has a dissociation constant of about $1\times10^{-5}$ M to about $1\times10^{-13}$ M to CD16 (FcγRIII). In embodiments, the Fc region of the IgG antibody has a dissociation constant of about $1\times10^{-5}$ M to about $1\times10^{-13}$ M to CD16 (FcγRIII). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$ M to about $1\times10^{-8}$ M, about $1\times10^{-6}$ M to about $1\times10^{-7}$ M, about $1\times10^{-7}$ M to about $1\times10^{-13}$ M, about $1\times10^{-7}$ M to about $1\times10^{-12}$ M, about $1\times10^{-7}$ M to about $1\times10^{-11}$ M, about $1\times10^{-7}$ M to about $1\times10^{-10}$ M, about $1\times10^{-7}$ M to about $1\times10^{-9}$ M, about $1\times10^{-7}$ M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$ M to about $1\times10^{-13}$ M, about $1\times10^{-9}$ M to about $1\times10^{-12}$ M, about $1\times10^{-9}$ M to about $1\times10^{-11}$ M, about $1\times10^{-9}$ M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD16 (FcγRIII). In embodiments, the Fc region of an IgG antibody described herein has a dissociation constant of about $1\times10^{-5}$ M, about $1\times10^{-6}$ M, about $1\times10^{-7}$ M, about $1\times10^{-8}$ M, about $1\times10^{-9}$ M, about $1\times10^{-10}$ M, about $1\times10^{-11}$ M, about $1\times10^{-12}$ M, or about $1\times10^{-13}$ M to CD16 (FcγRIII). In embodiments, the Fc region of an IgG antibody described herein has a dissociation constant of about $1\times10^{-5}$ M to CD16 (FcγRIII). In embodiments, the Fc region of an IgG antibody described herein has a dissociation constant of about $1\times10^{-6}$ M to CD16 (FcγRIII). In embodiments, the Fc region of an IgG antibody described herein has a dissociation constant of about $1\times10^{-7}$ M to CD16 (FcγRIII). In embodiments, the Fc region of an IgG antibody described herein has a dissociation constant of about $1\times10^{-8}$ M to CD16 (FcγRIII). In embodiments, the Fc region of an IgG antibody described herein has a dissociation constant of about $1\times10^{-9}$ M to CD16 (FcγRIII). In embodiments, the Fc region of an IgG antibody described herein has a dissociation constant of about $1\times10^{-10}$ M to CD16 (FcγRIII). In embodiments, the Fc region of an IgG antibody described herein has a dissociation constant of about $1\times10^{-11}$ M to CD16 (FcγRIII). In embodiments, the Fc region of an IgG antibody described herein has a dissociation constant of about $1\times10^{-12}$ M to CD16 (FcγRIII). In embodiments, the Fc region of an IgG antibody described herein has a dissociation constant of about $1\times10^{-13}$ M to CD16 (FcγRIII).

In embodiments, the Fc region of the IgG antibody has a dissociation constant of about $1\times10^{-5}$ M to about $1\times10^{-13}$ M to CD64 (FcγRI). In embodiments, the Fc region of the IgG antibody has a dissociation constant of about $1\times10^{-5}$ M to about $1\times10^{-13}$ M to CD64 (FcγRI). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$ M to about $1\times10^{-8}$ M, about $1\times10^{-6}$ M to about $1\times10^{-7}$ M, about $1\times10^{-7}$ M to about $1\times10^{-13}$ M, about $1\times10^{-7}$ M to about $1\times10^{-12}$ M, about $1\times10^{-7}$ M to about $1\times10^{-11}$ M, about $1\times10^{-7}$ M to about $1\times10^{-10}$ M, about $1\times10^{-7}$ M to about $1\times10^{-9}$ M, about $1\times10^{-7}$ M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$ M to about $1\times10^{-13}$ M, about $1\times10^{-9}$ M to about $1\times10^{-12}$ M, about $1\times10^{-9}$ M to about $1\times10^{-11}$ M, about $1\times10^{-9}$ M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD64 (FcγRI). In embodiments, the Fc region of an IgG antibody described herein has a dissociation constant of about $1\times10^{-5}$ M, about $1\times10^{-6}$ M, about $1\times10^{-7}$ M, about $1\times10^{-8}$ M, about $1\times10^{-9}$ M, about $1\times10^{-10}$ M, about $1\times10^{-11}$ M, about $1\times10^{-12}$ M, or about $1\times10^{-13}$ M to CD64 (FcγRI). In embodiments, the Fc region of an IgG antibody described herein has a dissociation constant of about $1\times10^{-5}$ M to CD64 (FcγRI) In embodiments, the Fc region of an IgG antibody described herein has a dissociation constant of about $1\times10^{-6}$ M to CD64 (FcγRI). In embodiments, the Fc region of an IgG antibody described herein has a dissociation constant of about $1\times10^{-7}$ M to CD64 (FcγRI). In embodiments, the Fc region of an IgG antibody described herein has a dissociation constant of about $1\times10^{-8}$ M to CD64 (FcγRI). In embodiments, the Fc region of an IgG antibody described herein has a dissociation constant of about $1\times10^{-9}$ M to CD64 (FcγRI). In embodiments, the Fc region of an IgG antibody described herein has a dissociation constant of about $1\times10^{-10}$ M to CD64 (FcγRI). In embodiments, the Fc region of an IgG antibody described herein has a dissociation constant of about $1\times10^{-11}$ M to CD64 (FcγRI). In embodiments, the Fc region of an IgG antibody described herein has a dissociation constant of about $1\times10^{-12}$ M to CD64 (FcγRI). In embodiments, the Fc region of an IgG antibody described herein has a dissociation constant of about $1\times10^{-13}$ M to CD64 (FcγRI).

In embodiments, the IgG antibody includes a protease resistant sequence resistant to cleavage by a protease. In embodiments, the protease is an IgG specific protease. In embodiments, the protease is an IgG endopeptidase. In embodiments, the IgG endopeptidase is selected from IdeS and IdeZ. In embodiments, the IgG antibody includes a protease resistant sequence resistant to cleavage by IdeS protease. In embodiments, the IgG antibody includes a protease resistant sequence resistant to cleavage by IdeZ protease.

In embodiments, the IgG antibody includes a protease resistant sequence resistant to cleavage by a protease specific for an ELLGGPS (SEQ ID NO: 544) amino acid sequence. In embodiments, the ELLGGPS (SEQ ID NO: 544) amino acid sequence specific protease, includes but is not limited to, pepsin, matrix metalloproteinase 7 (MMP7), matrix metalloproteinase 3 (MMP3), matrix metalloproteinase (MMP12), cathepsin G, and glutamyl endopeptidase V8 (GluV8). In embodiments, the IgG antibody includes a protease resistant sequence resistant to cleavage by pepsin. In embodiments, the IgG antibody includes a protease resistant sequence resistant to cleavage by matrix metalloproteinase 7 (MMP7). In embodiments, the IgG antibody includes a protease resistant sequence resistant to cleavage by matrix metalloproteinase 3 (MMP3). In embodiments, the IgG antibody includes a protease resistant sequence resistant to cleavage by matrix metalloproteinase (MMP12). In embodiments, the IgG antibody includes a protease resistant sequence resistant to cleavage by cathepsin G. In embodiments, the IgG antibody includes a protease resistant sequence resistant to cleavage by glutamyl endopeptidase V8 (GluV8).

In an aspect, provided herein are immunoglobulin G (IgG) antibodies, including a Fab region and an Fc region connected through a hinge region, where the Fc region has a dissociation constant of about $1\times10^{-5}$ M to about $1\times10^{-13}$ M to one or more of CD32 (FcγRII), CD16 (FcγRIII), and CD64 (FcγRI).

In embodiments, the IgG antibody is selected from an IgG1 antibody, an IgG2 antibody, an IgG3 antibody, and an IgG4 antibody. In embodiments, the IgG antibody is an IgG1 antibody. In embodiments, the IgG antibody is an IgG2 antibody. In embodiments, the IgG antibody is an IgG3 antibody. In embodiments, the IgG antibody is an IgG4 antibody.

In embodiments, the Fc region of an IgG antibody described herein has a dissociation constant of about $1\times10^{-5}$ M to about $1\times10^{-13}$ M to one or more of CD32 (FcγRII), CD16 (FcγRIII), and CD64 (FcγRI). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$ M to about $1\times10^{-9}$ M, about $1\times10^{-7}$ M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$M to about $1\times10^{-13}$ M, about $1\times10^{-9}$ M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to one or more of CD32 (FcγRII), CD16 (FcγRIII), and CD64 (FcγRI). In embodiments, the Fc region of an IgG antibody described herein has a dissociation constant of about $1\times10^{-5}$ M, about $1\times10^{-6}$ M, about $1\times10^{-7}$M, about $1\times10^{-8}$ M, about $1\times10^{-9}$M, about $1\times10^{-10}$M, about $1\times10^{-11}$ M, about $1\times10^{-12}$M, or about $1\times10^{-13}$ M to one or more of CD32 (FcγRII), CD16 (FcγRIII), and CD64 (FcγRI).

In embodiments, the Fc region of the IgG antibody has a dissociation constant of about $1\times10^{-5}$ M to about $1\times10^{-13}$ M to CD32 (FcγRII). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$M to about $1\times10^{-8}$ M, about $1\times10^{-6}$ M to about $1\times10^{-7}$ M, about $1\times10^{-7}$M to about $1\times10^{-13}$ M, about $1\times10^{-7}$ M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$ M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$M to about $1\times10^{-13}$ M, about $1\times10^{-9}$M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD32 (FcγRII). In embodiments, the Fc region of an IgG antibody described herein has a dissociation constant of about $1\times10^{-5}$ M, about $1\times10^{-6}$ M, about $1\times10^{-7}$ M, about $1\times10^{-8}$ M, about $1\times10^{-9}$M, about $1\times10^{-10}$ M, about $1\times10^{-11}$ M, about $1\times10^{-12}$ M, or about $1\times10^{-13}$ M to CD32 (FcγRII). In embodiments, the Fc region of an IgG antibody described herein has a dissociation constant of about $1\times10^{-5}$ M to CD32 (FcγRII). In embodiments, the Fc region of an IgG antibody described herein has a dissociation constant of about $1\times10^{-6}$ M to CD32 (FcγRII). In embodiments, the Fc region of an IgG antibody described herein has a dissociation constant of about $1\times10^{-7}$M to CD32 (FcγRII). In embodiments, the Fc region of an IgG antibody described herein has a dissociation constant of about $1\times10^{-8}$ M to CD32 (FcγRII). In embodiments, the Fc region of an IgG antibody described herein has a dissociation constant of about $1\times10^{-9}$M to CD32 (FcγRII). In embodiments, the Fc region of an IgG antibody described herein has a dissociation constant of about $1\times10^{-10}$ M to CD32 (FcγRII). In embodiments, the Fc region of an IgG antibody described herein has a dissociation constant of about $1\times10^{-11}$ M to CD32 (FcγRII). In embodiments, the Fc region of an IgG antibody described herein has a dissociation constant of about $1\times10^{-12}$ M to CD32 (FcγRII). In embodiments, the Fc region of an IgG antibody described herein has a dissociation constant of about $1\times10^{-13}$ M to CD32 (FcγRII).

In embodiments, the Fc region of the IgG antibody has a dissociation constant of about $1\times10^{-5}$ M to about $1\times10^{-13}$ M to CD16 (FcγRIII). In embodiments, the Fc region of the IgG antibody has a dissociation constant of about $1\times10^{-5}$ M to about $1\times10^{-13}$ M to CD16 (FcγRIII). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-9}$ M, about $1\times10^{-7}$ M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$ M to about $1\times10^{-13}$ M, about $1\times10^{-9}$M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD16 (FcγRIII). In embodiments, the Fc region of an IgG antibody described herein has a dissociation constant of about $1\times10^{-5}$ M, about $1\times10^{-6}$ M, about $1\times10^{-7}$M, about $1\times10^{-8}$M, about $1\times10^{-9}$M, about $1\times10^{-10}$ M, about $1\times10^{-11}$ M, about $1\times10^{-12}$ M, or about $1\times10^{-13}$ M to CD16 (FcγRIII). In embodiments, the Fc region of an IgG antibody described herein has a dissociation constant of about $1\times10^{-5}$ M to CD16 (FcγRIII). In embodiments, the Fc region of an IgG antibody described herein has a dissociation constant of about $1\times10^{-6}$ M to CD16 (FcγRIII). In embodiments, the Fc region of an IgG antibody described herein has a dissociation constant of about $1\times10^{-7}$M to CD16 (FcγRIII). In embodiments, the Fc region of an IgG antibody described herein has a dissociation constant of about $1\times10^{-8}$ M to CD16 (FcγRIII). In embodiments, the Fc region of an IgG antibody described herein has a dissociation constant of about $1\times10^{-9}$M to CD16 (FcγRIII). In embodiments, the Fc region of an IgG antibody described herein has a dissociation constant of about $1\times10^{-10}$ M to CD16 (FcγRIII). In embodiments, the Fc region of an IgG antibody described herein has a dissociation constant of about $1\times10^{-11}$ M to CD16 (FcγRIII). In embodiments, the Fc region of an IgG antibody described herein has a dissociation constant of about $1\times10^{-12}$ M to CD16 (FcγRIII). In embodiments, the Fc region of an IgG antibody described herein has a dissociation constant of about $1\times10^{-13}$ M to CD16 (FcγRIII).

In embodiments, the Fc region of the IgG antibody has a dissociation constant of about $1\times10^{-5}$ M to about $1\times10^{-13}$ M to CD64 (FcγRI). In embodiments, the Fc region of the IgG antibody has a dissociation constant of about $1\times10^{-5}$ M to about $1\times10^{-13}$ M to CD64 (FcγRI). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$ M, about $1\times10^{-7}$ M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$ M to about $1\times10^{-13}$ M, about $1\times10^{-9}$M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD64 (FcγRI). In embodiments, the Fc region of an IgG antibody described herein has a dissociation constant of about $1\times10^{-5}$ M, about $1\times10^{-6}$ M, about $1\times10^{-7}$M, about $1\times10^{-8}$ M, about $1\times10^{-9}$M, about $1\times10^{-10}$ M, about $1\times10^{-11}$ M, about $1\times10^{-12}$ M, or about $1\times10^{-13}$ M to CD64 (FcγRI). In embodiments, the Fc region of an IgG antibody described herein has a dissociation constant of about $1\times10^{-5}$ M to CD64 (FcγRI) In embodiments, the Fc region of an IgG antibody described herein has a dissociation constant of about $1\times10^{-6}$ M to CD64 (FcγRI). In embodiments, the Fc region of an IgG antibody described herein has a dissociation constant of about $1\times10^{-7}$M to CD64 (FcγRI). In embodiments, the Fc region of an IgG antibody described herein has a dissociation constant of about $1\times10^{-8}$ M to CD64 (FcγRI). In embodiments, the Fc region of an IgG antibody described herein has a dissociation constant of about $1\times10^{-9}$M to CD64 (FcγRI). In embodiments, the Fc region of an IgG antibody described herein has a dissociation constant of about $1\times10^{-10}$ M to CD64 (FcγRI). In embodiments, the Fc region of an IgG antibody described herein has a dissociation constant of about $1\times10^{-11}$ M to CD64 (FcγRI). In embodiments, the Fc region of an IgG antibody described herein has a dissociation constant of about $1\times10^{-12}$ M to CD64 (FcγRI). In embodiments, the Fc region of an IgG antibody described herein has a dissociation constant of about $1\times10^{-13}$ M to CD64 (FcγRI).

In embodiments, the Fc region includes one or more amino acid substitutions conferring higher binding affinity for one or more of CD32 (FcγRII), CD16 (FcγRIII), and CD64 (FcγRI) compared to a wild type Fc. In embodiments, the Fc region includes one or more amino acid substitutions conferring higher binding affinity for CD32 (FcγRII) compared to a wild type Fc. In embodiments, the Fc region includes one or more amino acid substitutions conferring higher binding affinity for CD16 (FcγRIII) compared to a wild type Fc. In embodiments, the Fc region includes one or more amino acid substitutions conferring higher binding affinity for CD64 (FcγRI) compared to a wild type Fc.

In embodiments, the Fc region includes one or more amino acid substitutions that confers higher binding affinity for CD16 (FcγRIII) compared to wild type and is selected from S252D, I351E, and A349L according to Kabat numbering. In embodiments, the Fc region includes a S252D amino acid substitution. In embodiments, the Fc region includes an I351E amino acid substitution. In embodiments, the Fc region includes an A349L amino acid substitution. In embodiments, the Fc region includes S252D and I351E amino acid substitutions. In embodiments, the Fc region includes S252D, I351E, and A349L amino acid substitutions.

In embodiments, the Fc region of the IgG antibody has a dissociation constant of about $1\times10^{-5}$ M to about $1\times10^{-13}$ M to CD32 (FcγRII). In an embodiments, the Fc region of the IgG antibody has a dissociation constant of about $1\times10^{-5}$ M to about $1\times10^{-13}$ M to CD16 (FcγRIII). In an embodiments, the Fc region of the IgG antibody has a dissociation constant of about $1\times10^{-5}$ M to about $1\times10^{-13}$ M to CD64 (FcγRI).

In embodiments, the IgG antibody includes a protease resistant sequence resistant to cleavage by a protease. In embodiments, the protease is an IgG specific protease. In embodiments, the IgG specific protease is selected from IdeS and IdeZ. In embodiments, the IgG antibody includes a protease resistant sequence resistant to cleavage by IdeS protease. In embodiments, the IgG antibody includes a protease resistant sequence resistant to cleavage by IdeZ protease.

In embodiments, the IgG antibody includes a protease resistant sequence resistant to cleavage by a protease specific for an ELLGGPS amino acid sequence (SEQ ID NO: 544). In embodiments, the ELLGGPS (SEQ ID NO:544) amino acid sequence specific protease, includes but is not limited to, pepsin, matrix metalloproteinase 7 (MMP7), matrix metalloproteinase 3 (MMP3), matrix metalloproteinase (MMP12), cathepsin G, and glutamyl endopeptidase V8 (GluV8). In embodiments, the IgG antibody includes a protease resistant sequence resistant to cleavage by pepsin. In embodiments, the IgG antibody includes a protease resistant sequence resistant to cleavage by matrix metalloproteinase 7 (MMP7). In embodiments, the IgG antibody includes a protease resistant sequence resistant to cleavage by matrix metalloproteinase 3 (MMP3). In embodiments, the IgG antibody includes a protease resistant sequence resistant to cleavage by matrix metalloproteinase (MMP12). In embodiments, the IgG antibody includes a protease resistant sequence resistant to cleavage by cathepsin G. In embodiments, the IgG antibody includes a protease resistant sequence resistant to cleavage by glutamyl endopeptidase V8 (GluV8).

In embodiments, the hinge region includes a protease resistant sequence. In embodiments, the sequence is between amino acid positions 246-252 according to Kabat numbering. In embodiments, the sequence is between positions corresponding to Kabat position 246-252. In embodiments, the protease resistant sequence is two or more amino acids in length. In embodiments, the protease resistant sequence is three amino acids in length. In embodiments, the protease resistant sequence is four amino acids in length. In embodiments, the protease resistant sequence is five amino acids in length. In embodiments, the protease resistant sequence is six amino acids in length. In embodiments, the protease resistant sequence is seven amino acids in length. In embodiments, the protease resistant sequence includes the amino acids of SEQ ID NO: 545. In embodiments, the protease resistant sequence includes the amino acids of SEQ ID NO: 546. In embodiments, the protease resistant sequence includes the amino acids of SEQ ID NO: 547.

III. Recombinant Proteins

In an aspect, provided herein are recombinant proteins including a Type I transmembrane domain, an immunoglobulin G (IgG) antibody, wherein the transmembrane domain is fused to the C-terminus of the IgG antibody, where the recombinant protein is resistant to cleavage by a protease.

In embodiments, the Type I transmembrane domain is capable of dimerization. In embodiments, the Type I transmembrane domain is selected from an EGFR, PDGFR-alpha, PDGFR-beta, HER2, HER3, HER4, FGFR1, FGFR2, FGFR3, FGFR4, VEGFR1, VEGFR2, VEGFR3, Trk-A, Trk-B, Trk-C, and insulin receptor transmembrane domain. In embodiments, the Type I transmembrane domain is an EGFR transmembrane domain. In embodiments, the Type I transmembrane domain is a PDGFR-alpha transmembrane domain. In embodiments, the Type I transmembrane domain is a PDGFR-beta transmembrane domain. In embodiments, the Type I transmembrane domain is an HER2 transmembrane domain. In embodiments, the Type I transmembrane domain is an HER3 transmembrane domain. In embodiments, the Type I transmembrane domain is an HER4 transmembrane domain. In embodiments, the Type I transmembrane domain is an FGFR1 transmembrane domain. In embodiments, the Type I transmembrane domain is an FGFR2 transmembrane domain. In embodiments, the Type I transmembrane domain is an FGFR3 transmembrane domain. In embodiments, the Type I transmembrane domain is an FGFR4 transmembrane domain. In embodiments, the Type I transmembrane domain is a VEGFR1 transmembrane domain. In embodiments, the Type I transmembrane domain is a VEGFR2 transmembrane domain. In embodiments, the Type I transmembrane domain is a VEGFR3 transmembrane domain. In embodiments, the Type I transmembrane domain is a Trk-A transmembrane domain. In embodiments, the Type I transmembrane domain is a Trk-B transmembrane domain. In embodiments, the Type I transmembrane domain is a Trk-C transmembrane domain. In embodiments, the Type I transmembrane domain is an insulin receptor transmembrane domain.

In embodiments, the recombinant protein includes an IgG antibody selected from IgG1, IgG2, IgG3, and IgG4. In embodiments, the IgG antibody is IgG1 antibody. In embodiments, the IgG antibody is IgG2 antibody. In embodiments, the IgG antibody is IgG3 antibody. In embodiments, the IgG antibody is IgG4 antibody.

In embodiments of the recombinant proteins provided herein, the IgG antibody includes an Fc (fragment crystallizable) region, a Fab (antigen-binding fragment) region, and a hinge region. In embodiments, the IgG antibody includes an Fc (fragment crystallizable) region. In embodiments, includes an Fc (antigen-binding fragment) region. In embodiments, the recombinant protein wherein the IgG antibody includes a hinge region.

In embodiments of the recombinant proteins provided herein, the hinge region includes a protease resistant sequence. In embodiments, the sequence is between amino acid positions 246-252 according to Kabat numbering. In embodiments, the sequence is between positions corresponding to Kabat positions 246-252. In embodiments, the protease resistant sequence is two or more amino acids in length. In embodiments, the protease resistant sequence is three amino acids in length. In embodiments, the protease resistant sequence is four amino acids in length. In embodiments, the protease resistant sequence is five amino acids in length. In embodiments, the protease resistant sequence is six amino acids in length. In embodiments, the protease resistant sequence is seven amino acids in length. In embodiments, the protease resistant sequence includes the amino acids of SEQ ID NO: 546. In embodiments, the protease resistant sequence includes the amino acids of SEQ ID NO:

545. In embodiments, the protease resistant sequence includes the amino acids of SEQ ID NO: 547.

In embodiments of the recombinant proteins provided herein, the Fc region of an IgG antibody described herein has a dissociation constant of about $1\times10^{-5}$ M to about $1\times10^{-13}$ M to one or more of CD32 (FcγRII), CD16 (FcγRIII), and CD64 (FcγRI). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$M to about $1\times10^{-10}$ M, about $1\times10^{-6}$ M to about $1\times10^{-9}$ M, about $1\times10^{-6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$ M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$ M to about $1\times10^{-13}$ M, about $1\times10^{-9}$M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to one or more of CD32 (FcγRII), CD16 (FcγRIII), and CD64 (FcγRI). In embodiments, the Fc region of an IgG antibody described herein has a dissociation constant of about $1\times10^{-5}$M, about $1\times10^{-6}$M, about $1\times10^{-7}$M, about $1\times10^{-8}$M, about $1\times10^{-9}$M, about $1\times10^{-10}$M, about $1\times10^{-11}$ M, about $1\times10^{-12}$ M, or about $1\times10^{-13}$ M to one or more of CD32 (FcγRII), CD16 (FcγRIII), and CD64 (FcγRI).

In embodiments of the recombinant proteins provided herein, the Fc region of the IgG antibody has a dissociation constant of about $1\times10^{-5}$ M to about $1\times10^{-13}$ M to CD32 (FcγRII). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$ M to about $1\times10^{-8}$ M, about $1\times10^{-6}$M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$ M, about $1\times10^{-7}$ M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$ M to about $1\times10^{-13}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD32 (FcγRII). In embodiments, the Fc region of an IgG antibody described herein has a dissociation constant of about $1\times10^{-5}$ M, about $1\times10^{-6}$M, about $1\times10^{-7}$ M, about $1\times10^{-8}$ M, about $1\times10^{-9}$M, about $1\times10^{-10}$M, about $1\times10^{-11}$ M, about $1\times10^{-12}$ M, or about $1\times10^{-13}$ M to CD32 (FcγRII). In embodiments, the Fc region of an IgG antibody described herein has a dissociation constant of about $1\times10^{-5}$ M to CD32 (FcγRII). In embodiments, the Fc region of an IgG antibody described herein has a dissociation constant of about $1\times10^{-6}$ M to CD32 (FcγRII). In embodiments, the Fc region of an IgG antibody described herein has a dissociation constant of about $1\times10^{-7}$M to CD32 (FcγRII). In embodiments, the Fc region of an IgG antibody described herein has a dissociation constant of about $1\times10^{-8}$ M to CD32 (FcγRII). In embodiments, the Fc region of an IgG antibody described herein has a dissociation constant of about $1\times10^{-9}$M to CD32 (FcγRII). In embodiments, the Fc region of an IgG antibody described herein has a dissociation constant of about $1\times10^{-10}$ M to CD32 (FcγRII). In embodiments, the Fc region of an IgG antibody described herein has a dissociation constant of about $1\times10^{-11}$ M to CD32 (FcγRII). In embodiments, the Fc region of an IgG antibody described herein has a dissociation constant of about $1\times10^{-12}$ M to CD32 (FcγRII). In embodiments, the Fc region of an IgG antibody described herein has a dissociation constant of out $1\times10^{-13}$ M to CD32 (FcγRII).

In embodiments of the recombinant proteins provided herein, the Fc region of the IgG antibody has a dissociation constant of about $1\times10^{-5}$ M to about $1\times10^{-13}$ M to CD16 (FcγRIII). In embodiments, the Fc region of the IgG antibody has a dissociation constant of about $1\times10^{-5}$ M to about $1\times10^{-13}$ M to CD16 (FcγRIII). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$M to about $1\times10^{-13}$ M, about $1\times10^{-9}$ M to about $1\times10^{-12}$ M, about $1\times10^{-9}$ M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD16 (FcγRIII). In embodiments, the Fc region of an IgG antibody described herein has a dissociation constant of about $1\times10^{-5}$ M, about $1\times10^{-6}$ M, about $1\times10^{-7}$M, about $1\times10^{-8}$M, about $1\times10^{-9}$ M, about $1\times10^{-10}$M, about $1\times10^{-11}$ M, about $1\times10^{-12}$ M, or about $1\times10^{-13}$ M to CD16 (FcγRIII). In embodiments, the Fc region of an IgG antibody described herein has a dissociation constant of about $1\times10^{-5}$ M to CD16 (FcγRIII). In embodiments, the Fc region of an IgG antibody described herein has a dissociation constant of about $1\times10^{6}$ M to CD16 (FcγRIII). In embodiments, the Fc region of an IgG antibody described herein has a dissociation constant of about $1\times10^{-7}$M to CD16 (FcγRIII). In embodiments, the Fc region of an IgG antibody described herein has a dissociation constant of about $1\times10^{-8}$ M to CD16 (FcγRIII). In embodiments, the Fc region of an IgG antibody described herein has a dissociation constant of about $1\times10^{-9}$ M to CD16 (FcγRIII). In embodiments, the Fc region of an IgG antibody described herein has a dissociation constant of about $1\times10^{-10}$ M to CD16 (FcγRIII). In embodiments, the Fc region of an IgG antibody described herein has a dissociation constant of about $1\times10^{-11}$ M to CD16 (FcγRIII). In embodiments, the Fc region of an IgG antibody described herein has a dissociation constant of about $1\times10^{-12}$ M to CD16 (FcγRIII). In embodiments, the Fc region of an IgG antibody described herein has a dissociation constant of about $1\times10^{-13}$ M to CD16 (FcγRIII).

In embodiments of the recombinant proteins provided herein, the Fc region of the IgG antibody has a dissociation constant of about $1\times10^{-5}$ M to about $1\times10^{-13}$ M to CD64 (FcγRI). In embodiments, the Fc region of the IgG antibody has a dissociation constant of about $1\times10^{-5}$ M to about $1\times10^{-13}$ M to CD64 (FcγRI). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$ M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$M to about $1\times10^{-13}$ M, about $1\times10^{-9}$M to about $1\times10^{-12}$ M, about $1\times10^{-9}$M to about $1\times10^{-11}$ M, about $1\times10^{-9}$ M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD64 (FcγRI). In embodiments, the Fc region of an IgG antibody described herein has a dissociation constant of about $1\times10^{-5}$ M, about $1\times10^{-6}$ M, about $1\times10^{-7}$M, about $1\times10^{-8}$ M, about $1\times10^{-9}$M, about $1\times10^{-10}$ M, about $1\times10^{-11}$ M, about $1\times10^{-12}$ M, or about $1\times10^{-13}$ M to CD64 (FcγRI). In embodiments, the Fc region of an IgG antibody described herein has a dissociation constant of about $1\times10^{-5}$ M to CD64 (FcγRI) In embodiments, the Fc region of an IgG antibody described herein has a dissociation constant of about $1\times10^{-6}$M to CD64 (FcγRI). In embodiments, the Fc region of an IgG antibody described herein has a dissociation constant of about $1\times10^{-7}$M to CD64 (FcγRI). In embodiments, the Fc region of an IgG antibody described herein has a dissociation constant of about $1\times10^{-8}$ M to CD64 (FcγRI). In embodiments, the Fc region of an IgG antibody described herein has a dissociation constant of about $1\times10^{-9}$ M to CD64 (FcγRI). In embodiments, the Fc region of an IgG antibody described herein has a dissociation constant of about $1\times10^{-10}$ M to CD64 (FcγRI). In embodiments, the Fc region of an IgG antibody described herein has a dissociation constant of about $1\times10^{-11}$ M to CD64 (FcγRI). In embodiments, the Fc region of an IgG antibody described herein has a dissociation constant of about $1\times10^{-12}$ M to CD64 (FcγRI). In embodiments, the Fc region of an IgG antibody described herein has a dissociation constant of about $1\times10^{-13}$ M to CD64 (FcγRI).

In embodiments, the IgG antibody includes a protease resistant sequence resistant to cleavage by a protease. In embodiments, the protease is an IgG specific protease. In embodiments, the IgG specific protease is selected from IdeS and IdeZ. In embodiments, the IgG antibody includes a protease resistant sequence resistant to cleavage by IdeS protease. In embodiments, the IgG antibody includes a protease resistant sequence resistant to cleavage by IdeZ protease.

In embodiments of the recombinant proteins provided herein, the IgG antibody includes a protease resistant sequence resistant to cleavage by a protease specific for an ELLGGPS amino acid sequence (SEQ ID NO: 544). In embodiments, the ELLGGPS (SEQ ID NO: 544) amino acid sequence specific protease, includes but is not limited to, pepsin, matrix metalloproteinase 7 (MMP7), matrix metalloproteinase 3 (MMP3), matrix metalloproteinase (MMP12), cathepsin G, and glutamyl endopeptidase V8 (GluV8). In embodiments, the IgG antibody includes a protease resistant sequence resistant to cleavage by pepsin. In embodiments, the IgG antibody includes a protease resistant sequence resistant to cleavage by matrix metalloproteinase 7 (MMP7). In embodiments, the IgG antibody includes a protease resistant sequence resistant to cleavage by matrix metalloproteinase 3 (MMP3). In embodiments, the IgG antibody includes a protease resistant sequence resistant to cleavage by matrix metalloproteinase (MMP12). In embodiments, the IgG antibody includes a protease resistant sequence resistant to cleavage by cathepsin G. In embodiments, the IgG antibody includes a protease resistant sequence resistant to cleavage by glutamyl endopeptidase V8 (GluV8).

In an aspect, provided herein are recombinant proteins including a Type I transmembrane domain, an immunoglobulin G (IgG) antibody, where the transmembrane domain is fused to the C-terminus of the IgG antibody and where the recombinant protein includes an Fc region with a dissociation constant of about $1\times10^{-5}$ M to about $1\times10^{-13}$ M to one or more of CD32 (FcγRII), CD16 (FcγRIII), and CD64 (FcγRI).

In embodiments, the Type I transmembrane domain is capable of dimerization. In embodiments, the Type I transmembrane domain is selected from an EGFR, PDGFR-alpha, PDGFR-beta, HER2, HER3, HER4, FGFR1, FGFR2, FGFR3, FGFR4, VEGFR1, VEGFR2, VEGFR3, Trk-A, Trk-B, Trk-C, and insulin receptor transmembrane domain. In embodiments, the Type I transmembrane domain is an EGFR transmembrane domain. In embodiments, the Type I transmembrane domain is a PDGFR-alpha transmembrane domain. In embodiments, the Type I transmembrane domain is a PDGFR-beta transmembrane domain. In embodiments, the Type I transmembrane domain is an HER2 transmembrane domain. In embodiments, the Type I transmembrane domain is an HER3 transmembrane domain. In embodiments, the Type I transmembrane domain is an HER4 transmembrane domain. In embodiments, the Type I transmembrane domain is an FGFR1 transmembrane domain. In embodiments, the Type I transmembrane domain is an FGFR2 transmembrane domain. In embodiments, the Type I transmembrane domain is an FGFR3 transmembrane domain. In embodiments, the Type I transmembrane domain is an FGFR4 transmembrane domain. In embodiments, the Type I transmembrane domain is a VEGFR1 transmembrane domain. In embodiments, the Type I transmembrane domain is a VEGFR2 transmembrane domain. In embodiments, the Type I transmembrane domain is a VEGFR3 transmembrane domain. In embodiments, the Type I transmembrane domain is a Trk-A transmembrane domain. In embodiments, the Type I transmembrane domain is a Trk-B transmembrane domain. In embodiments, the Type I transmembrane domain is a Trk-C transmembrane domain. In embodiments, the Type I transmembrane domain is an insulin receptor transmembrane domain.

In embodiments, the recombinant protein includes an IgG antibody selected from IgG1, IgG2, IgG3, and IgG4. In embodiments, the IgG antibody is IgG1 antibody. In embodiments, the IgG antibody is IgG2 antibody. In embodiments, the IgG antibody is IgG3 antibody. In embodiments, the IgG antibody is IgG4 antibody.

In embodiments of the recombinant proteins provided herein, the IgG antibody includes an Fc (fragment crystallizable) region, a Fab (antigen-binding fragment) region, and a hinge region. In embodiments, the IgG antibody includes an Fc (fragment crystallizable) region. In embodiments, includes an Fc (antigen-binding fragment) region. In embodiments, the recombinant protein wherein the IgG antibody includes a hinge region.

In embodiments of the recombinant proteins provided herein, the Fc region of an IgG antibody described herein has a dissociation constant of about $1\times10^{-5}$ M to about $1\times10^{-13}$ M to one or more of CD32 (FcγRII), CD16 (FcγRIII), and CD64 (FcγRI). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$ M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$ M to about $1\times10^{-13}$ M, about $1\times10^{-9}$M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to one or more of CD32 (FcγRII), CD16 (FcγRIII), and CD64 (FcγRI). In embodiments, the Fc region of an IgG antibody described herein has a dissociation constant of about $1\times10^{-5}$M, about $1\times10^{-6}$M, about $1\times10^{-7}$M, about $1\times10^{-8}$ M, about $1\times10^{-9}$M, about $1\times10^{-10}$M, about $1\times10^{-11}$M, about $1\times10^{-12}$ M, or about $1\times10^{-13}$ M to one or more of CD32 (FcγRII), CD16 (FcγRIII), and CD64 (FcγRI).

In embodiments of the recombinant proteins provided herein, the Fc region of the IgG antibody has a dissociation constant of about $1\times10^{-5}$ M to about $1\times10^{-13}$ M to CD32 (FcγRII). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$ M, about $1\times10^{-7}$ M to about $1\times10^{-8}$ M, about $1\times10^{-8}$ M to about $1\times10^{-13}$ M, about $1\times10^{-8}$ M to about $1\times10^{-12}$ M, about $1\times10^{-8}$M to about $1\times10^{-11}$ M, about $1\times10^{-8}$ M to about $1\times10^{-10}$ M, about $1\times10^{-8}$ M to about $1\times10^{-9}$ M, about $1\times10^{-9}$ M to about $1\times10^{-13}$ M, about $1\times10^{-9}$ M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD32 (FcγRII). In embodiments, the Fc region of an IgG antibody described herein has a dissociation constant of about $1\times10^{-5}$ M, about $1\times10^{-6}$ M, about $1\times10^{-7}$ M, about $1\times10^{-8}$ M, about $1\times10^{-9}$M, about $1\times10^{-10}$ M, about $1\times10^{-11}$ M, about $1\times10^{-12}$M, or about $1\times10^{-13}$ M to CD32 (FcγRII). In embodiments, the Fc region of an IgG antibody described herein has a dissociation constant of about $1\times10^{-5}$ M to CD32 (FcγRII). In embodiments, the Fc region of an IgG antibody described herein has a dissociation constant of about $1\times10^{-6}$ M to CD32 (FcγRII). In embodiments, the Fc region of an IgG antibody described herein has a dissociation constant of about $1\times10^{-7}$M to CD32 (FcγRII). In embodiments, the Fc region of an IgG antibody described herein has a dissociation constant of about $1\times10^{-8}$ M to CD32 (FcγRII). In embodiments, the Fc region of an IgG antibody described herein has a dissociation constant of about $1\times10^{-9}$M to CD32 (FcγRII). In embodiments, the Fc region of an IgG antibody described herein has a dissociation constant of about $1\times10^{-10}$ M to CD32 (FcγRII). In embodiments, the Fc region of an IgG antibody described herein has a dissociation constant of about $1\times10^{-11}$ M to CD32 (FcγRII). In embodiments, the Fc region of an IgG antibody described herein has a dissociation constant of about $1\times10^{-12}$ M to CD32 (FcγRII). In embodiments, the Fc region of an IgG antibody described herein has a dissociation constant of about $1\times10^{-13}$ M to CD32 (FcγRII).

In embodiments of the recombinant proteins provided herein, the Fc region of the IgG antibody has a dissociation constant of about $1\times10^{-5}$ M to about $1\times10^{-13}$ M to CD16 (FcγRIII). In embodiments, the Fc region of the IgG antibody has a dissociation constant of about $1\times10^{-5}$ M to about $1\times10^{-13}$ M to CD16 (FcγRIII). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M,

35 about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$M to about $1\times10^{-13}$ M, about $1\times10^{-9}$M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD16 (FcγRIII). In embodiments, the Fc region of an IgG antibody described herein has a dissociation constant of about $1\times10^{-5}$ M, about $1\times10^{-6}$M, about $1\times10^{-7}$M, about $1\times10^{-8}$M, about $1\times10^{-9}$M, about $1\times10^{-10}$M, about $1\times10^{-11}$ M, about $1\times10^{-12}$ M, or about $1\times10^{-13}$ M to CD16 (FcγRIII). In embodiments, the Fc region of an IgG antibody described herein has a dissociation constant of about $1\times10^{-5}$ M to CD16 (FcγRIII). In embodiments, the Fc region of an IgG antibody described herein has a dissociation constant of about $1\times10^{6}$ M to CD16 (FcγRIII). In embodiments, the Fc region of an IgG antibody described herein has a dissociation constant of about $1\times10^{-7}$ M to CD16 (FcγRIII). In embodiments, the Fc region of an IgG antibody described herein has a dissociation constant of about $1\times10^{-8}$ M to CD16 (FcγRIII). In embodiments, the Fc region of an IgG antibody described herein has a dissociation constant of about $1\times10^{-9}$ M to CD16 (FcγRIII). In embodiments, the Fc region of an IgG antibody described herein has a dissociation constant of about $1\times10^{-10}$ M to CD16 (FcγRIII). In embodiments, the Fc region of an IgG antibody described herein has a dissociation constant of about $1\times10^{-11}$ M to CD16 (FcγRIII). In embodiments, the Fc region of an IgG antibody described herein has a dissociation constant of about $1\times10^{-12}$ M to CD16 (FcγRIII). In embodiments, the Fc region of an IgG antibody described herein has a dissociation constant of about $1\times10^{-13}$ M to CD16 (FcγRIII).

In embodiments of the recombinant proteins provided herein, the Fc region of the IgG antibody has a dissociation constant of about $1\times10^{-5}$ M to about $1\times10^{-13}$ M to CD64 (FcγRI). In embodiments, the Fc region of the IgG antibody has a dissociation constant of about $1\times10^{-5}$ M to about $1\times10^{-13}$ M to CD64 (FcγRI). In embodiments, the Fc region has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$M to about $1\times10^{-11}$ M, about $1\times10^{-6}$ M to about $1\times10^{-10}$ M, about $1\times10^{-6}$ M to about $1\times10^{-9}$ M, about $1\times10^{-6}$M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$ M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$M to about $1\times10^{-13}$ M, about $1\times10^{-9}$ M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD64 (FcγRI). In embodiments, the Fc region of an IgG antibody described herein has a dissociation constant of about $1\times10^{-5}$ M, about $1\times10^{-6}$ M, about $1\times10^{-7}$

36

M, about $1\times10^{-8}$ M, about $1\times10^{-9}$M, about $1\times10^{-10}$ M, about $1\times10^{-11}$ M, about $1\times10^{-12}$ M, or about $1\times10^{-13}$ M to CD64 (FcγRI). In embodiments, the Fc region of an IgG antibody described herein has a dissociation constant of about $1\times10^{-5}$ M to CD64 (FcγRI). In embodiments, the Fc region of an IgG antibody described herein has a dissociation constant of about $1\times10^{-6}$ M to CD64 (FcγRI). In embodiments, the Fc region of an IgG antibody described herein has a dissociation constant of about $1\times10^{-7}$M to CD64 (FcγRI). In embodiments, the Fc region of an IgG antibody described herein has a dissociation constant of about $1\times10^{-8}$ M to CD64 (FcγRI). In embodiments, the Fc region of an IgG antibody described herein has a dissociation constant of about $1\times10^{-9}$ M to CD64 (FcγRI). In embodiments, the Fc region of an IgG antibody described herein has a dissociation constant of about $1\times10^{-10}$ M to CD64 (FcγRI). In embodiments, the Fc region of an IgG antibody described herein has a dissociation constant of about $1\times10^{-11}$ M to CD64 (FcγRI). In embodiments, the Fc region of an IgG antibody described herein has a dissociation constant of about $1\times10^{-12}$ M to CD64 (FcγRI). In embodiments, the Fc region of an IgG antibody described herein has a dissociation constant of about $1\times10^{-13}$ M to CD64 (FcγRI).

In embodiments of the recombinant proteins provided herein, the hinge region includes a protease resistant sequence. In embodiments, the sequence is between amino acid positions 246-252 according to Kabat numbering. In embodiments, the sequence is between positions corresponding to Kabat positions 246-252. In embodiments, the protease resistant sequence is two or more amino acids in length. In embodiments, the protease resistant sequence is three amino acids in length. In embodiments, the protease resistant sequence is four amino acids in length. In embodiments, the protease resistant sequence is five amino acids in length. In embodiments, the protease resistant sequence is six amino acids in length. In embodiments, the protease resistant sequence is seven amino acids in length. In embodiments, the protease resistant sequence includes the amino acids of SEQ ID NO: 546. In embodiments, the protease resistant sequence includes the amino acids of SEQ ID NO: 545. In embodiments, the protease resistant sequence includes the amino acids of SEQ ID NO: 547.

In embodiments, the IgG antibody includes a protease resistant sequence resistant to cleavage by a protease. In embodiments, the protease is an IgG specific protease. In embodiments, the IgG specific protease is selected from IdeS and IdeZ. In embodiments, the IgG antibody includes a protease resistant sequence resistant to cleavage by IdeS protease. In embodiments, the IgG antibody includes a protease resistant sequence resistant to cleavage by IdeZ protease.

In embodiments, the IgG antibody hinge region is two amino acids in length and includes an amino acid sequence of DW, YD, QW, QE, PW, QD, or DD. In embodiments, the IgG antibody hinge region is three amino acids in length and includes an amino acid sequence of XDW, XDW, XYD, XQW, XQE, XPW, XQD, or XDD, where X is any amino acid. In embodiments, the IgG antibody hinge region is four amino acids in length and includes an amino acid sequence of XXDW, XXDW, XXYD, XXQW, XXQE, XXPW, XXQD, or XXDD, where X is any amino acid. In embodiments, the IgG antibody hinge region is five amino acids in length and includes an amino acid sequence of XXXDW, XXXYD, XXXQW, XXXQE, XXXPW, XXXQD, or XXXDD, where X is any amino acid. In embodiments, the IgG antibody hinge region is six amino acids in length and includes an amino acid sequence of XXXXDW, XXXXYD, XXXXQW, XXXXQE, XXXXPW, XXXXQD, or XXXXDD, where X is any amino acid. In embodiments, the IgG antibody hinge region is seven amino acids in length and includes an amino acid sequence of XXXXXDW, XXXXXYD, XXXXXQW, XXXXXQE, XXXXXPW, XXXXXQD, or XXXXXDD, where X is any amino acid. In embodiments, the IgG antibody hinge region is eight amino acids in length and includes an amino acid sequence of XXXXXXDW, XXXXXXYD, XXXXXXQW, XXXXXXQE, XXXXXXPW, XXXXXXQD, or XXXXXXDD, where X is any amino acid. In embodiments, the IgG antibody hinge region is nine amino acids in length and includes an amino acid sequence of XXXXXXXDW, XXXXXXXYD, XXXXXXXQW, XXXXXXXQE, XXXXXXXPW, XXXXXXXQD, or XXXXXXXDD, where X is any amino acid. In embodiments, the IgG antibody hinge region includes an amino acid sequence of XCWDW (SEQ ID NO:649), XXCWDW (SEQ ID NO:650), XXXCWDW (SEQ ID NO:651), XXXXXCWDW (SEQ ID NO: 652), XXXXXXCWDW (SEQ ID NO:653), XXXXXXXCWDW (SEQ ID NO:654), ETCWDW (SEQ ID NO:647), DSCWDW (SEQ ID NO:646), YDCWDW (SEQ ID NO:645), DDCWDW (SEQ ID NO:644), DMCWDW (SEQ ID NO:643), EHCWDW (SEQ ID NO:642), IICWDW (SEQ ID NO:641), DVCWDW (SEQ ID NO:640), EFCWDW (SEQ ID NO:639), FNCWDW (SEQ ID NO:638), EETCWDW (SEQ ID NO:545), EDSCWDW (SEQ ID NO:546), EETCWDD (SEQ ID NO:637), or EETQWDD (SEQ ID NO:636) where X is any amino acid.

In embodiments, the IgG antibody hinge region includes DW, YD, QW, QE, PW, QD, DD, CWDW (SEQ ID NO:648), ETCWDW (SEQ ID NO:647), DSCWDW (SEQ ID NO:646), YDCWDW (SEQ ID NO:645), DDCWDW (SEQ ID NO:644), DMCWDW (SEQ ID NO:643), EHCWDW (SEQ ID NO:642), IICWDW (SEQ ID NO:641), DVCWDW (SEQ ID NO:640), EFCWDW (SEQ ID NO:639), FNCWDW (SEQ ID NO:638), EETCWDW (SEQ ID NO: 545), EDSCWDW (SEQ ID NO:546), EETCWDD (SEQ ID NO:637), EETCWSW (SEQ ID NO: 547), EETQWDD (SEQ ID NO:636). In some aspects, the variants or homologs have one, two, three, four, five or six amino acid sequence identity.

In embodiments, the IgG antibody includes a Fab region that is identical to the Fab region of any one of Abciximab, Adalimumab, Alemtuzumab, Alemtuzumab, Alirocumab, Arcitumomab, Atezolizumab, Avelumab, Basiliximab, Belimumab, Besilesomab, Bevacizumab, Bevacizumab, Bezlotoxumab, Brentuximab, Brodalumab, Canakinumab, Capromab, Catumaxomab, Certolizumab pegol, Cetuximab, Daratumumab, Denosumab, Dinutuximab, Dupilumab, Durvalumab, Eculizumab, Efalizumab, Elotuzumab, Fanolesomab, Gemtuzumab ozogamicin, Golimumab, Ibritumomab tiuxetan, Idarucizumab, Imiciromab, Infliximab, Ipilimumab, Mepolizumab, Muromonab-CD3, Natalizumab, Necitumumab, Nivolumab, Nofetumomab, Obiltoxaximab, Obinutuzumab, Ocrelizumab, Ofatumumab, Olaratumab, Omalizumab, Palivizumab, Panitumumab, Pembrolizumab, Pertuzumab, Ramucirumab, Ranibizumab, Raxibacumab, Reslizumab, Rituximab, Satumomab, Secukinumab, Siltuximab, Sulesomab, Tocilizumab, Tositumomab, Trastuzumab, Trastuzumab emtansine, Ustekinumab, Vedolizumab, Volocumab, and Votumumab. In embodiments, the IgG antibody includes a Fab region that is identical to the Fab region of Abciximab. In embodiments, the IgG antibody includes a Fab region that is identical to the Fab region of Adalimumab. In embodiments, the IgG antibody includes a Fab region that is identical to the Fab region of Alemtuzumab. In embodiments, the IgG antibody includes a Fab region that is identical to the Fab region of Alemtuzumab. In embodiments, the IgG antibody includes a Fab region that is identical to the Fab region of Alirocumab. In embodiments, the IgG antibody includes a Fab region that is identical to the Fab region of Arcitumomab. In embodiments, the IgG antibody includes a Fab region that is identical to the Fab region of Atezolizumab. In embodiments, the IgG antibody includes a Fab region that is identical to the Fab region of Avelumab. In embodiments, the IgG antibody includes a Fab region that is identical to the Fab region of Basiliximab. In embodiments, the IgG antibody includes a Fab region that is identical to the Fab region of Belimumab. In embodiments, the IgG antibody includes a Fab region that is identical to the Fab region of Besilesomab. In embodiments, the IgG antibody includes a Fab region that is identical to the Fab region of Bevacizumab. In embodiments, the IgG antibody includes a Fab region that is identical to the Fab region of Bezlotoxumab. In embodiments, the IgG antibody includes a Fab region that is identical to the Fab region of Brentuximab. In embodiments, the IgG antibody includes a Fab region that is identical to the Fab region of Brodalumab. In embodiments, the IgG antibody includes a Fab region that is identical to the Fab region of Canakinumab. In embodiments, the IgG antibody includes a Fab region that is identical to the Fab region of Capromab. In embodiments, the IgG antibody includes a Fab region that is identical to the Fab region of Catumaxomab. In embodiments, the IgG antibody includes a Fab region that is identical to the Fab region of Certolizumab pegol. In embodiments, the IgG antibody includes a Fab region that is identical to the Fab region of Cetuximab. In embodiments, the IgG antibody includes a Fab region that is identical to the Fab region of Daratumumab. In embodiments, the IgG antibody includes a Fab region that is identical to the Fab region of Denosumab. In embodiments, the IgG antibody includes a Fab region that is identical to the Fab region of Dinutuximab. In embodiments, the IgG antibody includes a Fab region that is identical to the Fab region of Dupilumab. In embodiments, the IgG antibody includes a Fab region that is identical to the Fab region of Durvalumab. In embodiments, the IgG antibody includes a Fab region that is identical to the Fab region of Eculizumab. In embodiments, the IgG antibody includes a Fab region that is identical to the Fab region of Efalizumab. In embodiments, the IgG antibody includes a Fab region that is identical to the Fab region of Elotuzumab. In embodiments, the IgG antibody includes a Fab region that is identical to the Fab region of Fanolesomab. In embodiments, the IgG antibody includes a Fab region that is identical to the Fab region of Gemtuzumab ozogamicin. In embodiments, the IgG antibody includes a Fab region that is identical to the Fab region of Golimumab. In embodiments, the IgG antibody includes a Fab region that is identical to the Fab region of Ibritumomab tiuxetan. In embodiments, the IgG antibody includes a Fab region that is identical to the Fab region of Idarucizumab. In embodiments, the IgG antibody includes a Fab region that is identical to the Fab region of Imiciromab. In embodiments, the IgG antibody includes a Fab region that is identical to the Fab region of Infliximab. In embodiments, the IgG antibody includes a Fab region that is identical to the Fab region of Ipilimumab. In embodiments, the IgG antibody includes a Fab region that is identical to the Fab region of Mepolizumab. In embodiments, the IgG antibody includes a Fab region that is identical to the Fab region of Muromonab-CD3. In embodiments, the IgG antibody includes a Fab region that is identical to the Fab region of Natalizumab. In embodiments, the IgG antibody includes a Fab region that is identical to the Fab region of Necitumumab. In embodiments, the IgG antibody includes a Fab region that is identical to the Fab region of Nivolumab. In embodiments, the IgG antibody includes a Fab region that is identical to the Fab region of Nofetumomab. In embodiments, the IgG antibody includes a Fab region that is identical to the Fab region of Obiltoxaximab. In embodiments, the IgG antibody includes a Fab region that is identical to the Fab region of Obinutuzumab. In embodiments, the IgG antibody includes a Fab region that is identical to the Fab region of Ocrelizumab. In embodiments, the IgG antibody includes a Fab region that is identical to the Fab region of Ofatumumab. In embodiments, the IgG antibody includes a Fab region that is identical to the Fab region of Olaratumab. In embodiments, the IgG antibody includes a Fab region that is identical to the Fab region of Omalizumab. In embodiments, the IgG antibody includes a Fab region that is identical to the Fab region of Palivizumab. In embodiments, the IgG antibody includes a Fab region that is identical to the Fab region of Panitumumab. In embodiments, the IgG antibody includes a Fab region that is identical to the Fab region of Pembrolizumab. In embodiments, the IgG antibody includes a Fab region that is identical to the Fab region of Pertuzumab. In embodiments, the IgG antibody includes a Fab region that is identical to the Fab region of Ramucirumab. In embodiments, the IgG antibody includes a Fab region that is identical to the Fab region of Ranibizumab. In embodiments, the IgG antibody includes a Fab region that is identical to the Fab region of Raxibacumab. In embodiments, the IgG antibody includes a Fab region that is identical to the Fab region of Reslizumab. In embodiments, the IgG antibody includes a Fab region that is identical to the Fab region of Rituximab. In embodiments, the IgG antibody includes a Fab region that is identical to the Fab region of Satumomab. In embodiments, the IgG antibody includes a Fab region that is identical to the Fab region of Secukinumab. In embodiments, the IgG antibody includes a Fab region that is identical to the Fab region of Siltuximab. In embodiments, the IgG antibody includes a Fab region that is identical to the Fab region of Sulesomab. In embodiments, the IgG antibody includes a Fab region that is identical to the Fab region of Tocilizumab. In embodiments, the IgG antibody includes a Fab region that is identical to the Fab region of Tositumomab. In embodiments, the IgG antibody includes a Fab region that is identical to the Fab region of Trastuzumab. In embodiments, the IgG antibody includes a Fab region that is identical to the Fab region of Trastuzumab emtansine. In embodiments, the IgG antibody includes a Fab region that is identical to the Fab region of Ustekinumab. In embodiments, the IgG antibody includes a Fab region that is identical to the Fab region of Vedolizumab. In embodiments, the IgG antibody includes a Fab region that is identical to the Fab region of Volocumab. In embodiments, the IgG antibody includes a Fab region that is identical to the Fab region of Votumumab.

In embodiments of the recombinant proteins provided herein, the IgG antibody includes a protease resistant sequence resistant to cleavage by a protease specific for an ELLGGPS amino acid sequence (SEQ ID NO: 544). In embodiments, the ELLGGPS amino acid sequence (SEQ ID NO: 544) specific protease, includes but is not limited to, pepsin, matrix metalloproteinase 7 (MMP7), matrix metalloproteinase 3 (MMP3), matrix metalloproteinase (MMP12), cathepsin G, and glutamyl endopeptidase V8

(GluV8). In embodiments, the IgG antibody includes a protease resistant sequence resistant to cleavage by pepsin. In embodiments, the IgG antibody includes a protease resistant sequence resistant to cleavage by matrix metalloproteinase 7 (MMP7). In embodiments, the IgG antibody includes a protease resistant sequence resistant to cleavage by matrix metalloproteinase 3 (MMP3). In embodiments, the IgG antibody includes a protease resistant sequence resistant to cleavage by matrix metalloproteinase (MMP12). In embodiments, the IgG antibody includes a protease resistant sequence resistant to cleavage by cathepsin G. In embodiments, the IgG antibody includes a protease resistant sequence resistant to cleavage by glutamyl endopeptidase V8 (GluV8).

IV. Anti-CD20 Antibodies

In an aspect, provided herein is an anti-CD20 antibody including a complementarity determining region (CDR) as encoded by a nucleic acid sequence of any of one SEQ ID Nos: 551-588.

Figure 14:
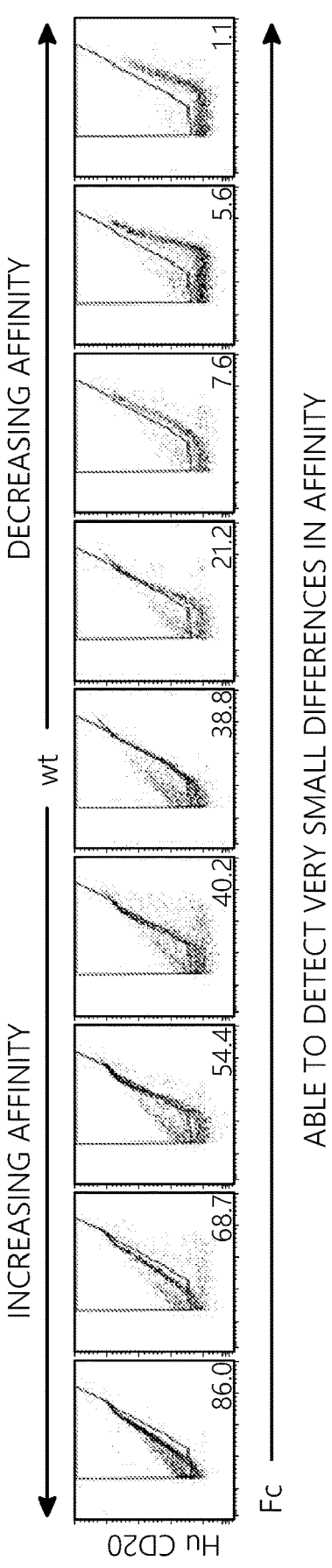
FIG. 14 illustrates flow cytometry density plots of sequence-dependent rituximab target selection and corresponding sequences. The representative example shows multiple clones from the rituximab library consisting of CD20 binding variants and flow cytometric measurement of binding affinity for each variant to a fluorescently labeled CD20 molecule, as demonstrated in FIG. 13. In the bottom panel, the second column from from left shows (from top to bottom) the sequence of CDR1 WT (SEQ ID NO:548) and CDR1 sequences from clones P01A09 (SEQ ID NO:551), P01B01 (SEQ ID NO:552), P02C12 (SEQ ID NO:553), P02F01 (SEQ ID NO:554), P03A05 (SEQ ID NO: 555), P05B09 (SEQ ID NO:556), P05H07 (SEQ ID NO:557), P04A02 (SEQ ID NO:558), P05F06 (SEQ ID NO:559), and P07C04 (SEQ ID NO:560). The fourth column from left shows (from top to bottom) the sequence of CDR2 WT (SEQ ID NO:549), and CDR2 sequences from clones P04D06 (SEQ ID NO:561), P04F01 (SEQ ID NO:562), P04F02 (SEQ ID NO:563), P04G03 (SEQ ID NO:564), P04H06 (SEQ ID NO:565), P04H07 (SEQ ID NO:566), P06A06 (SEQ ID NO: 567), P06B11 (SEQ ID NO:568), P06H01 (SEQ ID NO:569), P04D09 (SEQ ID NO:570), P05A03 (SEQ ID NO:571), P05A12 (SEQ ID NO:572), P05B02 (SEQ ID NO:573), P06B04 (SEQ ID NO: 574), P06B11 (SEQ ID NO:575), P06H05 (SEQ ID NO:576), P06H11 (SEQ ID NO:577), P07F02 (SEQ ID NO:578), P07F10 (SEQ ID NO:579), and P08B05 (SEQ ID NO:580). The sixth column from left shows (from top to bottom) the sequence of CDR3 WT (SEQ ID NO:550), and CDR3 sequences from clones P07C02 (SEQ ID NO:581), P07H08 (SEQ ID NO:582), P07H10 (SEQ ID NO:583), P08A01 (SEQ ID NO:584), P08B11 (SEQ ID NO:585), P08G02 (SEQ ID NO: 586), P07A06 (SEQ ID NO:587), and P08E05 (SEQ ID NO:588).

In embodiments, provided herein is an anti-CD20 antibody that binds CD20 or an antigen fragment thereof, where the antibody includes a complementarity determining region (CDR) and ecoded by a nucleic acid sequence as set forth in FIG. 14 (also reproduced in Tables 1, 2, and 3). In embodiments, provided herein is an anti-CD20 antibody that binds CD20 or an antigen fragment thereof, where the antibody includes a complementarity determining region (CDR) with amino acid sequence as set forth in Tables 1, 2 or 3. In embodiments, provided herein is an anti-CD20 antibody that binds CD20 or an antigen fragment thereof, where the antibody includes a complementarity determining region (CDR) with amino an acid sequence of any one of SEQ ID Nos: 589-629 or 633-635. In embodiments, provided herein is an antibody that binds CD20 or an antigen fragment thereof, with higher binding affinity to CD20 compared to non-mutated Rituximab (a CD20 binding antibody). In embodiments, provided herein is an antibody that binds CD20 or an antigen fragment thereof, with higher binding affinity to CD20 and includes a protease resistant hinge region when compared to non-mutated Rituximab (a CD20 binding antibody). In embodiments, provided herein is an antibody that binds CD20 or an antigen fragment thereof, with higher binding affinity to CD20 and includes mutations in one or more of the heavy chain CDR1, heavy chain CDR2, heavy chain CDR3, light chain CDR1, light chain CDR2, and light chain CDR3 compared to non-mutated Rituximab (a CD20 binding antibody).

In embodiments, the anti-CD20 antibody includes a heavy chain CDR1 encoded by a nucleotide sequence of TATACCGGGGAAGCGGTATAAC (SEQ ID NO: 551). In embodiments, the anti-CD20 antibody further includes a heavy chain CDR2 encoded by a nucleotide sequence of ATTTATCCGGGCAACGGCGAT (SEQ ID NO: 549), and a heavy chain CDR3 encoded by nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), the light chain CDR2 is encoded by a nucleotide sequence of GGAAGCGGCACCAGC (SEQ ID NO: 631), and the light chain CDR3 is encoded by a nucleotide sequence of TGGACCAGCAACCCGCCG (SEQ ID NO: 632). In embodiments, this anti-CD20 antibody is referred to as P01A09 and is further described in the description of Table 1 below. In embodiments, the anti- CD20 antibody is encoded by a nucleic acid sequence that encodes the amino acid sequence of rituximab, except that the heavy chain CDR1 sequence is encoded by a nucleotide sequence of TATACCGGGGAAGCGGTATAAC (SEQ ID NO: 551).

In embodiments, the anti-CD20 antibody includes a heavy chain CDR1 amino acid sequence of YTGKRYN (SEQ ID NO: 592). In embodiments, the anti-CD20 antibody further includes a heavy chain CDR2 amino acid sequence of IYPGNGD (SEQ ID NO: 590) and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P01A09 and is further described in the description of Table 1 below. In embodiments, the anti-CD20 antibody has the amino acid sequence of rituximab, except that the heavy chain CDR1 amino acid sequence is YTGKRYN (SEQ ID NO: 592).

In embodiments, the anti-CD20 antibody includes a heavy chain CDR1 encoded by a nucleotide sequence of TATACCTGTTTTAGGTATAAC (SEQ ID NO: 552). In embodiments, the anti-CD20 antibody further includes a heavy chain CDR2 encoded by a nucleotide sequence of ATTTATCCGGGCAACGGCGAT (SEQ ID NO: 549), and a heavy chain CDR3 encoded by nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), the light chain CDR2 is encoded by a nucleotide sequence of GGAAGCGGCACCAGC (SEQ ID NO: 631), and the light chain CDR3 is encoded by a nucleotide sequence of TGGACCAGCAACCCGCCG (SEQ ID NO: 632). In embodiments, this anti-CD20 antibody is referred to as P01B01 and is further described in the description of Table 1 below. In embodiments, the anti-CD20 antibody is encoded by a nucleic acid sequence that encodes the amino acid sequence of rituximab, except that the heavy chain CDR I sequence is encoded by a nucleotide sequence of TATACCTGTTTTAGGTATAAC (SEQ ID NO: 552).

In embodiments, the anti-CD20 antibody includes a heavy chain CDR1 amino acid sequence of YTCFRYN (SEQ ID NO: 593). In embodiments, the anti-CD20 antibody further includes a heavy chain CDR2 amino acid sequence of IYPGNGD (SEQ ID NO: 590) and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P01B01 and is further described in the description of Table 1 below. In embodiments, the anti-CD20 antibody has the amino acid sequence of rituximab, except that the heavy chain CDR1 amino acid sequence is YTCFRYN (SEQ ID NO: 593).

In embodiments, the anti-CD20 antibody includes a heavy chain CDR1 encoded by a nucleotide sequence of TATACCTTCACAATTCGTTTG (SEQ ID NO: 553). In embodiments, the anti-CD20 antibody further includes a heavy chain CDR2 encoded by a nucleotide sequence of ATTTATCCGGGCAACGGCGAT (SEQ ID NO: 549), and a heavy chain CDR3 encoded by nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), the light chain CDR2 is encoded by a nucleotide sequence of GGAAGCGGCACCAGC (SEQ ID NO: 631), and the light chain CDR3 is encoded by a nucleotide sequence of TGGACCAGCAACCCGCCG (SEQ ID NO: 632). In embodiments, this anti-CD20 antibody is referred to as P02C12 and is further described in the description of Table 1 below. In embodiments, the anti-CD20 antibody is encoded by a nucleic acid sequence that encodes the amino acid sequence of rituximab, except that the heavy chain CDR I sequence is encoded by a nucleotide sequence of TATACCTTCACAATTCGTTTG (SEQ ID NO: 553).

In embodiments, the anti-CD20 antibody includes a heavy chain CDR1 amino acid sequence of YTFTIRL (SEQ ID NO: 594). In embodiments, the anti-CD20 antibody further includes a heavy chain CDR2 amino acid sequence of IYPGNGD (SEQ ID NO: 590) and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P02C12 and is further described in the description of Table 1 below. In embodiments, the anti-CD20 antibody has the amino acid sequence of rituximab, except that the heavy chain CDR1 amino acid sequence is YTFTIRL (SEQ ID NO: 594).

In embodiments, the anti-CD20 antibody includes a heavy chain CDR1 encoded by a nucleotide sequence of TATACCGGGCGTTTTTATAAC (SEQ ID NO: 554). In embodiments, the anti-CD20 antibody further includes a heavy chain CDR2 encoded by a nucleotide sequence of ATTTATCCGGGCAACGGCGAT (SEQ ID NO: 549), and a heavy chain CDR3 encoded by nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), the light chain CDR2 is encoded by a nucleotide sequence of GGAAGCGGCACCAGC (SEQ ID NO: 631), and the light chain CDR3 is encoded by a nucleotide sequence of TGGACCAGCAACCCGCCG (SEQ ID NO: 632). In embodiments, this anti-CD20 antibody is referred to as P02F01 and is further described in the description of Table 1 below. In embodiments, the anti-CD20 antibody is encoded by a nucleic acid sequence that encodes the amino acid sequence of rituximab, except that the heavy chain CDR1 sequence is encoded by a nucleotide sequence of TATACCGGGCGTTTTTATAAC (SEQ ID NO: 554).

In embodiments, the anti-CD20 antibody includes a heavy chain CDR1 amino acid sequence of YTGRFYN (SEQ ID NO: 595). In embodiments, the anti-CD20 antibody further includes a heavy chain CDR2 amino acid sequence of IYPGNGD (SEQ ID NO: 590) and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P02F01 and is further described in the description of Table 1 below. In embodiments, the anti-CD20 antibody has the amino acid sequence of rituximab, except that the heavy chain CDR1 amino acid sequence is YTGRFYN (SEQ ID NO: 595).

In embodiments, the anti-CD20 antibody includes a heavy chain CDR1 encoded by a nucleotide sequence of TATACCAGTTGGATGTATAAC (SEQ ID NO: 555). In embodiments, the anti-CD20 antibody further includes a heavy chain CDR2 encoded by a nucleotide sequence of ATTTATCCGGGCAACGGCGAT (SEQ ID NO: 549), and a heavy chain CDR3 encoded by nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), the light chain CDR2 is encoded by a nucleotide sequence of GGAAGCGGCACCAGC (SEQ ID NO: 631), and the light chain CDR3 is encoded by a nucleotide sequence of TGGACCAGCAACCCGCCG (SEQ ID NO: 632). In embodiments, this anti-CD20 antibody is referred to as P03A05 and is further described in the description of Table 1 below. In embodiments, the anti-CD20 antibody is encoded by a nucleic acid sequence that encodes the amino acid sequence of rituximab, except that the heavy chain CDR I sequence is encoded by a nucleotide sequence of TATACCAGTTGGATGTATAAC (SEQ ID NO: 555).

In embodiments, the anti-CD20 antibody includes a heavy chain CDR1 amino acid sequence of YTSWMYN (SEQ ID NO: 596). In embodiments, the anti-CD20 antibody further includes a heavy chain CDR2 amino acid sequence of IYPGNGD (SEQ ID NO: 590) and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P03A05 and is further described in the description of Table 1 below. In embodiments, the anti-CD20 antibody has the amino acid sequence of rituximab, except that the heavy chain CDR1 amino acid sequence is YTSWMYN (SEQ ID NO: 596).

In embodiments, the anti-CD20 antibody includes a heavy chain CDR1 encoded by a nucleotide sequence of TGGTTGTGGACAAGCTATAAC (SEQ ID NO: 556). In embodiments, the anti-CD20 antibody further includes a heavy chain CDR2 encoded by a nucleotide sequence of ATTTATCCGGGCAACGGCGAT (SEQ ID NO: 549), and a heavy chain CDR3 encoded by nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), the light chain CDR2 is encoded by a nucleotide sequence of GGAAGCGGCACCAGC (SEQ ID NO: 631), and the light chain CDR3 is encoded by a nucleotide sequence of TGGACCAGCAACCCGCCG (SEQ ID NO: 632). In embodiments, this anti-CD20 antibody is referred to as P05B09 and is further described in the description of Table 1 below. In embodiments, the anti-CD20 antibody is encoded by a nucleic acid sequence that encodes the amino acid sequence of rituximab, except that the heavy chain CDR1 sequence is encoded by a nucleotide sequence of TGGTTGTGGACAAGCTATAAC (SEQ ID NO: 556).

In embodiments, the anti-CD20 antibody includes a heavy chain CDR1 amino acid sequence of WLWTSYN (SEQ ID NO: 597). In embodiments, the anti-CD20 antibody further includes a heavy chain CDR2 amino acid sequence of IYPGNGD (SEQ ID NO: 590) and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P05B09 and is further described in the description of Table 1 below. In embodiments, the anti-CD20 antibody has the amino acid sequence of rituximab, except that the heavy chain CDR1 amino acid sequence is WLWTSYN (SEQ ID NO: 597).

In embodiments, the anti-CD20 antibody includes a heavy chain CDR1 encoded by a nucleotide sequence of TATACCTGGGGGATTTATAAC (SEQ ID NO: 557). In embodiments, the anti-CD20 antibody further includes a heavy chain CDR2 encoded by a nucleotide sequence of ATTTATCCGGGCAACGGCGAT (SEQ ID NO: 549), and a heavy chain CDR3 encoded by nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), the light chain CDR2 is encoded by a nucleotide sequence of GGAAGCGGCACCAGC (SEQ ID NO: 631), and the light chain CDR3 is encoded by a nucleotide sequence of TGGACCAGCAACCCGCCG (SEQ ID NO: 632). In embodiments, this anti-CD20 antibody is referred to as P05H07 and is further described in the description of Table 1 below. In embodiments, the anti-CD20 antibody is encoded by a nucleic acid sequence that encodes the amino acid sequence of rituximab, except that the heavy chain CDR1 sequence is encoded by a nucleotide sequence of TATACCTGGGGGATTTATAAC (SEQ ID NO: 557).

In embodiments, the anti-CD20 antibody includes a heavy chain CDR1 amino acid sequence of YTWGIYN (SEQ ID NO: 598). In embodiments, the anti-CD20 antibody further includes a heavy chain CDR2 amino acid sequence of IYPGNGD (SEQ ID NO: 590) and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P05H07 and is further described in the description of Table 1 below. In embodiments, the anti-CD20 antibody has the amino acid sequence of rituximab, except that the heavy chain CDR1 amino acid sequence is YTWGIYN (SEQ ID NO: 598).

In embodiments, the anti-CD20 antibody includes a heavy chain CDR1 encoded by a nucleotide sequence of TATACCTTCACAAGGTATAAT (SEQ ID NO: 558). In embodiments, the anti-CD20 antibody further includes a heavy chain CDR2 encoded by a nucleotide sequence of ATTTATCCGGGCAACGGCGAT (SEQ ID NO: 549), and a heavy chain CDR3 encoded by nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), the light chain CDR2 is encoded by a nucleotide sequence of GGAAGCGGCACCAGC (SEQ ID NO: 631), and the light chain CDR3 is encoded by a nucleotide sequence of TGGACCAGCAACCCGCCG (SEQ ID NO: 632). In embodiments, this anti-CD20 antibody is referred to as P04A02 and is further described in the description of Table 1 below. In embodiments, the anti-CD20 antibody is encoded by a nucleic acid sequence that encodes the amino acid sequence of rituximab, except that the heavy chain CDR1 sequence is encoded by a nucleotide sequence of TATACCTTCACAAGGTATAAT (SEQ ID NO: 558).

In embodiments, the anti-CD20 antibody includes a heavy chain CDR1 amino acid sequence of YTFTRYN (SEQ ID NO: 599). In embodiments, the anti-CD20 antibody further includes a heavy chain CDR2 amino acid sequence of IYPGNGD (SEQ ID NO: 590) and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P04A02 and is further described in the description of Table 1 below. In embodiments, the anti-CD20 antibody has the amino acid sequence of rituximab, except that the heavy chain CDR1 amino acid sequence is YTFTRYN (SEQ ID NO: 599).

In an embodiment, the antibody that binds CD20 or an antigen fragment thereof includes in sequence: a CDR1 encoded by a nucleotide sequence of TATACCTTCACAT-TTCCTTAT (SEQ ID NO: 559). In embodiments, the anti-CD20 antibody further includes a heavy chain CDR2 encoded by a nucleotide sequence of ATT-TATCCGGGCAACGGCGAT (SEQ ID NO: 549), and a heavy chain CDR3 encoded by nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), the light chain CDR2 is encoded by a nucleotide sequence of GGAAGCGGCACCAGC (SEQ ID NO: 631), and the light chain CDR3 is encoded by a nucleotide sequence of TGGACCAGCAACCCGCCG (SEQ ID NO: 632). In embodiments, this anti-CD20 antibody is referred to as P05F06 and is further described in the description of Table 1 below. In embodiments, the anti-CD20 antibody is encoded by a nucleic acid sequence that encodes the amino acid sequence of rituximab, except that the heavy chain CDR1 sequence is encoded by a nucleotide sequence of TATACCTTCACATTTCCTTAT (SEQ ID NO: 559).

In embodiments, the anti-CD20 antibody includes a heavy chain CDR1 amino acid sequence of YTFTFPY (SEQ ID NO: 600). In embodiments, the anti-CD20 antibody further includes a heavy chain CDR2 amino acid sequence of IYPGNGD (SEQ ID NO: 590) and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P05F06 and is further described in the description of Table 1 below. In embodiments, the anti-CD20 antibody has the amino acid sequence of rituximab, except that the heavy chain CDR1 amino acid sequence is YTFTFPY (SEQ ID NO: 600).

In embodiments, the anti-CD20 antibody includes a heavy chain CDR1 encoded by a nucleotide sequence of TATACCGGTATTCGGTATAAC (SEQ ID NO: 560). In embodiments, the anti-CD20 antibody further includes a heavy chain CDR2 encoded by a nucleotide sequence of ATTTATCCGGGCAACGGCGAT (SEQ ID NO: 549), and a heavy chain CDR3 encoded by nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), the light chain CDR2 is encoded by a nucleotide sequence of GGAAGCGGCACCAGC (SEQ ID NO: 631), and the light chain CDR3 is encoded by a nucleotide sequence of TGGACCAGCAACCCGCCG (SEQ ID NO: 632). In embodiments, this anti-CD20 antibody is referred to as P07C04 and is further described in the description of Table 1 below. In embodiments, the anti-CD20 antibody is encoded by a nucleic acid sequence that encodes the amino acid sequence of rituximab, except that the heavy chain CDR1 sequence is encoded by a nucleotide sequence of TATACCGGTATTCGGTATAAC (SEQ ID NO: 560).

In embodiments, the anti-CD20 antibody includes a heavy chain CDR1 amino acid sequence of YTGIRYN (SEQ ID NO: 601). In embodiments, the anti-CD20 antibody further includes a heavy chain CDR2 amino acid sequence of IYPGNGD (SEQ ID NO: 590) and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P07C04 and is further described in the description of Table 1 below. In embodiments, the anti-CD20 antibody has the amino acid sequence of rituximab, except that the heavy chain CDR1 amino acid sequence is YTGIRYN (SEQ ID NO: 601).

In embodiments, the anti-CD20 antibody includes a heavy chain CDR2 encoded by a nucleotide sequence of ATT-TATCCGGGCTTGTATCTT (SEQ ID NO: 561). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P04D06 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCTTGTATCTT (SEQ ID NO: 561).

In embodiments, the anti-CD20 antibody includes a heavy chain CDR2 amino acid sequence of IYPGLYL (SEQ ID NO: 602). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P04D06 and is further described in the description of Table 2 below. In embodiments, the anti-CD20 antibody has the amino acid sequence of rituximab, except that the heavy chain CDR2 amino acid sequence is IYPGLYL (SEQ ID NO: 602).

In embodiments, the anti-CD20 antibody includes a heavy chain CDR2 encoded by a nucleotide sequence of CDR2 encoded by a nucleotide sequence of ATT-TATCCGGGCACGCTGCTG (SEQ ID NO: 562). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P04F01 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCACGCTGCTG (SEQ ID NO: 562).

In embodiments, the anti-CD20 antibody includes a heavy chain CDR2 amino acid sequence of IYPGTLL (SEQ ID NO: 603). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P04F01 and is further described in the description of Table 2 below. In embodiments, the anti-CD20 antibody has the amino acid sequence of rituximab, except that the heavy chain CDR2 amino acid sequence is IYPGTLL (SEQ ID NO: 603).

In embodiments, the anti-CD20 antibody includes a heavy chain CDR2 encoded by a nucleotide sequence of ATT-TATCCGGGCCATATGGGG (SEQ ID NO: 563). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P04F02 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCCATATGGGG (SEQ ID NO: 563).

In embodiments, the anti-CD20 antibody includes a heavy chain CDR2 amino acid sequence of IYPGHMG (SEQ ID NO: 604). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P04F02 and is further described in the description of Table 2 below. In embodiments, the anti-CD20 antibody has the amino acid sequence of rituximab, except that the heavy chain CDR2 amino acid sequence is IYPGHMG (SEQ ID NO: 604).

In embodiments, the anti-CD20 antibody includes a heavy chain CDR2 encoded by a nucleotide sequence of ATT-TATCCGGGCATGCTTTGG (SEQ ID NO: 564). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P04G03 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCATGCTTTGG (SEQ ID NO: 564).

In embodiments, the anti-CD20 antibody includes a heavy chain CDR2 amino acid sequence of IYPGMLW (SEQ ID NO: 605). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P04G03 and is further described in the description of Table 2 below. In embodiments, the anti-CD20 antibody has the amino acid sequence of rituximab, except that the heavy chain CDR2 amino acid sequence is IYPGMLW (SEQ ID NO: 605).

In embodiments, the anti-CD20 antibody includes a heavy chain CDR2 encoded by a nucleotide sequence of ATT-TATCCGGGCGCTGTTTCG (SEQ ID NO: 565). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P04H06 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCGCTGTTTCG (SEQ ID NO: 565).

In embodiments, the anti-CD20 antibody includes a heavy chain CDR2 amino acid sequence of YTFTSYN (SEQ ID NO: 589). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P04H06 and is further described in the description of Table 2 below. In embodiments, the anti-CD20 antibody has the amino acid sequence of rituximab, except that the heavy chain CDR2 amino acid sequence is IYPGAVS (SEQ ID NO: 606).

In embodiments, the anti-CD20 antibody includes a heavy chain CDR2 encoded by a nucleotide sequence of ATT-TATCCGGGCACTCATAAG (SEQ ID NO: 566). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P04H07 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCACTCATAAG (SEQ ID NO: 566).

In embodiments, the anti-CD20 antibody includes a heavy chain CDR2 amino acid sequence of IYPGTHK (SEQ ID NO: 607). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P04H07 and is further described in the description of Table 2 below. In embodiments, the anti-CD20 antibody has the amino acid sequence of rituximab, except that the heavy chain CDR2 amino acid sequence is f IYPGTHK (SEQ ID NO: 607).

In embodiments, the anti-CD20 antibody includes a heavy chain CDR2 encoded by a nucleotide sequence of ATT-TATCCGGGCACTCAGTCT (SEQ ID NO: 567). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P06A06 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCACTCAGTCT (SEQ ID NO: 567).

In embodiments, the anti-CD20 antibody includes a heavy chain CDR2 amino acid sequence of IYPGTQS (SEQ ID NO: 608). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P06A06 and is further described in the description of Table 2 below. In embodiments, the anti-CD20 antibody has the amino acid sequence of rituximab, except that the heavy chain CDR2 amino acid sequence is IYPGTQS (SEQ ID NO: 608).

In embodiments, the anti-CD20 antibody includes a heavy chain CDR2 encoded by a nucleotide sequence of ATT-TATCCGGGCAATGCGGAT (SEQ ID NO: 568). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P06B11 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCAATGCGGAT (SEQ ID NO: 568).

In embodiments, the anti-CD20 antibody includes a heavy chain CDR2 amino acid sequence of IYPGNAD (SEQ ID NO: 609). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P06B11 and is further described in the description of Table 2 below. In embodiments, the anti-CD20 antibody has the amino acid sequence of rituximab, except that the heavy chain CDR2 amino acid sequence is IYPGNAD (SEQ ID NO: 609).

In embodiments, the anti-CD20 antibody includes a heavy chain CDR2 encoded by a nucleotide sequence of ATT-TATCCGGGCAGTTTTGAG (SEQ ID NO: 569). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P06H01 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCAGTTTTGAG (SEQ ID NO: 569).

In embodiments, the anti-CD20 antibody includes a heavy chain CDR2 amino acid sequence of IYPGSFE (SEQ ID NO: 610). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P06H01 and is further described in the description of Table 2 below. In embodiments, the anti-CD20 antibody has the amino acid sequence of rituximab, except that the heavy chain CDR2 amino acid sequence is IYPGSFE (SEQ ID NO: 610).

In embodiments, the anti-CD20 antibody includes a heavy chain CDR2 encoded by a nucleotide sequence of ATT-TATCCGGGCACGTTTCTT (SEQ ID NO: 570). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P04D09 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCACGTTTCTT (SEQ ID NO: 570).

In embodiments, the anti-CD20 antibody includes a heavy chain CDR2 amino acid sequence of IYPGTFL (SEQ ID NO: 611). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P04D09 and is further described in the description of Table 2 below. In embodiments, the anti-CD20 antibody has the amino acid sequence of rituximab, except that the heavy chain CDR2 amino acid sequence is IYPGTFL (SEQ ID NO: 611).

In embodiments, the anti-CD20 antibody includes a heavy chain CDR2 encoded by a nucleotide sequence of ATT-TATCCGGTTACGGGCGAT (SEQ ID NO: 571). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P05A03 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGTTACGGGCGAT (SEQ ID NO: 571).

In embodiments, the anti-CD20 antibody includes a heavy chain CDR2 amino acid sequence of IYPVTGD (SEQ ID NO: 612). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P05A03 and is further described in the description of Table 2 below. In embodiments, the anti-CD20 antibody has the amino acid sequence of rituximab, except that the heavy chain CDR2 amino acid sequence is IYPVTGD (SEQ ID NO: 612).

In embodiments, the anti-CD20 antibody includes a heavy chain CDR2 encoded by a nucleotide sequence of ATT-TATCCGTATCTGGGCGAT (SEQ ID NO: 572). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P05A12 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGTATCTGGGCGAT (SEQ ID NO: 572).

In embodiments, the anti-CD20 antibody includes a heavy chain CDR2 amino acid sequence of IYPGLYL (SEQ ID NO: 602). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P05A12 and is further described in the description of Table 2 below. In embodiments, the anti-CD20 antibody has the amino acid sequence of rituximab, except that the heavy chain CDR2 amino acid sequence is IYPYLGD (SEQ ID NO: 613).

In embodiments, the anti-CD20 antibody includes a heavy chain CDR2 encoded by a nucleotide sequence of TTTATCCGTGGAATGGCGAT (SEQ ID NO: 573). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P05B02 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGTGGAATGGCGAT (SEQ ID NO: 573).

In embodiments, the anti-CD20 antibody includes a heavy chain CDR2 amino acid sequence of IYPWNGD (SEQ ID NO: 614). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P05B02 and is further described in the description of Table 2 below. In embodiments, the anti-CD20 antibody has the amino acid sequence of rituximab, except that the heavy chain CDR2 amino acid sequence is IYPWNGD (SEQ ID NO: 614).

In embodiments, the anti-CD20 antibody includes a heavy chain CDR2 encoded by a nucleotide sequence of ATT-TATCCGGGCTTGTATCTT (SEQ ID NO: 561). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P06B04 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCTCTGTGGGGCGAT (SEQ ID NO: 574).

In embodiments, the anti-CD20 antibody includes a heavy chain CDR2 amino acid sequence of IYPLWGD (SEQ ID NO: 615). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P06B04 and is further described in the description of Table 2 below. In embodiments, the anti-CD20 antibody has the amino acid sequence of rituximab, except that the heavy chain CDR2 amino acid sequence is IYPLWGD (SEQ ID NO: 615).

In embodiments, the anti-CD20 antibody includes a heavy chain CDR2 encoded by a nucleotide sequence of ATT-TATCCGGGCAGTAGTCGT (SEQ ID NO: 575). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P06B11 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCAGTAGTCGT (SEQ ID NO: 575).

In embodiments, the anti-CD20 antibody includes a heavy chain CDR2 amino acid sequence of IYPGSSR (SEQ ID NO: 616). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P06B11 and is further described in the description of Table 2 below. In embodiments, the anti-CD20 antibody has the amino acid sequence of rituximab, except that the heavy chain CDR2 amino acid sequence is IYPGSSR (SEQ ID NO: 616).

In embodiments, the anti-CD20 antibody includes a heavy chain CDR2 encoded by a nucleotide sequence of ATT-TATCCGGGCACTTTTCGT (SEQ ID NO: 576). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P06H05 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCACTTTTCGT (SEQ ID NO: 576).

In embodiments, the anti-CD20 antibody includes a heavy chain CDR2 amino acid sequence of IYPGTFR (SEQ ID NO: 617). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P06H05 and is further described in the description of Table 2 below. In embodiments, the anti-CD20 antibody has the amino acid sequence of rituximab, except that the heavy chain CDR2 amino acid sequence is IYPGTFR (SEQ ID NO: 617).

In embodiments, the anti-CD20 antibody includes a heavy chain CDR2 encoded by a nucleotide sequence of ATT-TATCCGGGCGTTGGTCGG (SEQ ID NO: 577). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P06H11 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCGTTGGTCGG (SEQ ID NO: 577).

In embodiments, the anti-CD20 antibody includes a heavy chain CDR2 amino acid sequence of IYPGVGR (SEQ ID NO: 618). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P06H11 and is further described in the description of Table 2 below. In embodiments, the anti-CD20 antibody has the amino acid sequence of rituximab, except that the heavy chain CDR2 amino acid sequence is IYPGVGR (SEQ ID NO: 618).

In embodiments, the anti-CD20 antibody includes a heavy chain CDR2 encoded by a nucleotide sequence of ATT-TATCCGGGCTCTCAGGCG (SEQ ID NO: 578). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P07F02 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCTCTCAGGCG (SEQ ID NO: 578).

In embodiments, the anti-CD20 antibody includes a heavy chain CDR2 amino acid sequence of IYPGSEA (SEQ ID NO: 619). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P07F02 and is further described in the description of Table 2 below. In embodiments, the anti-CD20 antibody has the amino acid sequence of rituximab, except that the heavy chain CDR2 amino acid sequence is IYPGSEA (SEQ ID NO: 619).

In embodiments, the anti-CD20 antibody includes a heavy chain CDR2 encoded by a nucleotide sequence of ATT-TATCCGGGCAGTAATATG (SEQ ID NO: 579). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P07F10 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCAGTAATATG (SEQ ID NO: 579).

In embodiments, the anti-CD20 antibody includes a heavy chain CDR2 amino acid sequence of IYPGSNM (SEQ ID NO: 620). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P07F10 and is further described in the description of Table 2 below. In embodiments, the anti-CD20 antibody has the amino acid sequence of rituximab, except that the heavy chain CDR2 amino acid sequence is IYPGSNM (SEQ ID NO: 620).

In embodiments, the anti-CD20 antibody includes a heavy chain CDR2 encoded by a nucleotide sequence of ATT-TATCCGGGCGCTTTTCTT (SEQ ID NO: 580). In embodiments, the anti-CD20 antibody further includes a heavy chain CDR1 encoded by a nucleotide sequence of TATACCTTCACAAGCTATAAC (SEQ ID NO: 548), and a heavy chain CDR3 encoded by a nucleotide sequence of CGCAGCACCTATTATGGCGGCGATTGGTATTTTAAC (SEQ ID NO: 550). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P08B05 and is further described in the description of Table 2 below. In embodiments, the anti-CD20 antibody is encoded by a nucleic acid sequence that encodes the amino acid sequence of rituximab, except that the heavy chain CDR2 sequence is encoded by a nucleotide sequence of ATTTATCCGGGCGCTTTTCTT (SEQ ID NO: 580).

In embodiments, the anti-CD20 antibody includes a heavy chain CDR2 amino acid sequence of IYPGAFL (SEQ ID NO: 621). In embodiments, the anti-CD20 antibody further includes a heavy chain CDR1 amino acid sequence of YTFTSYN (SEQ ID NO: 589), and a heavy chain CDR3 amino acid sequence of RSTYYGGDWYFN (SEQ ID NO: 591). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P08B05 and is further described in the description of Table 2 below. In embodiments, the anti-CD20 antibody has the amino acid sequence of rituximab, except that the heavy chain CDR2 amino acid sequence is IYPGAFL (SEQ ID NO: 621).

In embodiments, the anti-CD20 antibody includes a heavy chain CDR3 encoded by a nucleotide sequence of CAGTC-TATTTATTATGGCGGCGATTGGTATTTTAAC (SEQ ID NO: 581). In embodiments, the anti-CD20 antibody further includes a heavy chain CDR1 encoded by a nucleotide sequence of TATACCTTCACAAGCTATAAC (SEQ ID NO: 548), and a heavy chain CDR2 encoded by a nucleotide sequence of ATTTATCCGGGCAACGGCGAT (SEQ ID NO: 549). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P07C02 and is further described in the description of Table 3 below. In embodiments, the anti-CD20 antibody is encoded by a nucleic acid sequence that encodes the amino acid sequence of rituximab, except that the heavy chain CDR3 sequence is encoded by a nucleotide sequence of CAGTCTATTTATTATGGCGGCGATTGGTATTTTAAC (SEQ ID NO: 581).

In embodiments, the anti-CD20 antibody includes a heavy chain CDR3 amino acid sequence of QSIYYGGDWYFN (SEQ ID NO: 622). In embodiments, the anti-CD20 antibody further includes a heavy chain CDR1 amino acid sequence of YTFTSYN (SEQ ID NO: 589), and a heavy chain CDR2 amino acid sequence of IYPGNGD (SEQ ID NO: 590). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P07C02 and is further described in the description of Table 3 below. In embodiments, the anti-CD20 antibody has the amino acid sequence of rituximab, except that the heavy chain CDR3 amino acid sequence is QSIYYGGDWYFN (SEQ ID NO: 622).

In embodiments, the anti-CD20 antibody includes a heavy chain CDR3 encoded by a nucleotide sequence of CGCAGCACCTATTATGGCGGCGATTGGCTGATTGCT (SEQ ID NO: 582). In embodiments, the anti-CD20 antibody further includes a heavy chain CDR1 encoded by a nucleotide sequence of TATACCTTCACAAGCTATAAC (SEQ ID NO: 548), and a heavy chain CDR2 encoded by a nucleotide sequence of ATTTATCCGGGCAACGGCGAT (SEQ ID NO: 549). In embodiments, the anti-CD20 antibody further includes a light chain CDR1 encoded by a encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P07H08 and is further described in the description of Table 3 below. In embodiments, the anti-CD20 antibody is encoded by a nucleic acid sequence that encodes the amino acid sequence of rituximab, except that the heavy chain CDR3 sequence is encoded by a nucleotide sequence of CGCAGCACCTATTATGGCGGCGATTGGCTGATTGCT (SEQ ID NO: 582).

In embodiments, the anti-CD20 antibody includes a heavy chain CDR3 amino acid sequence of RSTYYGGDWLIA (SEQ ID NO: 623). In embodiments, the anti-CD20 antibody further includes a heavy chain CDR1 amino acid sequence of YTFTSYN (SEQ ID NO: 589), and a heavy chain CDR2 amino acid sequence of IYPGNGD (SEQ ID NO: 590). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P07H08 and is further described in the description of Table 3 below. In embodiments, the anti-CD20 antibody has the amino acid sequence of rituximab, except that the heavy chain CDR3 amino acid sequence is RSTYYGGDWLIA (SEQ ID NO: 623).

In embodiments, the anti-CD20 antibody includes a heavy chain CDR3 encoded by a nucleotide sequence of CGCAGCACCGTGGCGGGGGGCGATTGGTATTTTAA (SEQ ID NO: 583). In embodiments, the anti-CD20 antibody further includes a heavy chain CDR1 encoded by a nucleotide sequence of TATACCTTCACAAGCTATAAC (SEQ ID NO: 548), and a heavy chain CDR2 encoded by a nucleotide sequence of ATTTATCCGGGCAACGGCGAT (SEQ ID NO: 549). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P07H10 and is further described in the description of Table 3 below. In embodiments, the anti-CD20 antibody is encoded by a nucleic acid sequence that encodes the amino acid sequence of rituximab, except that the heavy chain CDR3 sequence is encoded by a nucleotide sequence of CGCAGCACCGTGGGGGGGGCGATTGGTATTTTAA (SEQ ID NO: 583).

In embodiments, the anti-CD20 antibody includes a heavy chain CDR3 amino acid sequence of RSTVAGGDWYFN (SEQ ID NO: 624). In embodiments, the anti-CD20 antibody further includes a heavy chain CDR1 amino acid sequence of YTFTSYN (SEQ ID NO: 589), and a heavy chain CDR2 amino acid sequence of IYPGNGD (SEQ ID NO: 590). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P07H10 and is further described in the description of Table 3 below. In embodiments, the anti-CD20 antibody has the amino acid sequence of rituximab, except that the heavy chain CDR3 amino acid sequence is RSTVAGGDWYFN (SEQ ID NO: 624).

In embodiments, the anti-CD20 antibody includes a heavy chain CDR3 encoded by a nucleotide sequence of CGCAGCACCTATTATGGCGGCGAT-TGGCGGTGGCGG (SEQ ID NO: 584). In embodiments, the anti-CD20 antibody further includes a heavy chain CDR1 encoded by a nucleotide sequence of TATACCTT-CACAAGCTATAAC (SEQ ID NO: 548), and a heavy chain CDR2 encoded by a nucleotide sequence of ATT-TATCCGGGCAACGGCGAT (SEQ ID NO: 549). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P08A01 and is further described in the description of Table 3 below. In embodiments, the anti-CD20 antibody is encoded by a nucleic acid sequence that encodes the amino acid sequence of rituximab, except that the heavy chain CDR3 sequence is encoded by a nucleotide sequence of CGCAGCACCTATTATGGCGGCGAT-TGGCGGTGGCGG (SEQ ID NO: 584).

In embodiments, the anti-CD20 antibody includes a heavy chain CDR3 amino acid sequence of RSTYYGGDWRWR (SEQ ID NO: 625). In embodiments, the anti-CD20 antibody further includes a heavy chain CDR1 amino acid sequence of YTFTSYN (SEQ ID NO: 589), and a heavy chain CDR2 amino acid sequence of IYPGNGD (SEQ ID NO: 590). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P08A01 and is further described in the description of Table 3 below. In embodiments, the anti-CD20 antibody has the amino acid sequence of rituximab, except that the heavy chain CDR3 amino acid sequence is RSTYYGGDWRWR (SEQ ID NO: 625).

In embodiments, the anti-CD20 antibody includes a heavy chain CDR3 encoded by a nucleotide sequence of CGCAGCACCTATTATGGCGGGTTTTGGTATTTTAAC (SEQ ID NO: 585). In embodiments, the anti-CD20 antibody further includes a heavy chain CDR1 encoded by a nucleotide sequence of TATACCTTCACAAGCTATAAC (SEQ ID NO: 548), and a heavy chain CDR2 encoded by a nucleotide sequence of ATTTATCCGGGCAACGGCGAT (SEQ ID NO: 549). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P08B11 and is further described in the description of Table 3 below. In embodiments, the anti-CD20 antibody is encoded by a nucleic acid sequence that encodes the amino acid sequence of rituximab, except that the heavy chain CDR3 sequence is encoded by a nucleotide sequence of CGCAGCACCTATTATGGCGGGTTTTGGTATTTTAAC (SEQ ID NO: 585).

In embodiments, the anti-CD20 antibody includes a heavy chain CDR3 amino acid sequence of RSTYYGGFWYFN (SEQ ID NO: 626). In embodiments, the anti-CD20 antibody further includes a heavy chain CDR1 amino acid sequence of YTFTSYN (SEQ ID NO: 589), and a heavy chain CDR2 amino acid sequence of IYPGNGD (SEQ ID NO: 590). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P08B11 and is further described in the description of Table 3 below. In embodiments, the anti-CD20 antibody has the amino acid sequence of rituximab, except that the heavy chain CDR3 amino acid sequence is RSTYYGGFWYFN (SEQ ID NO: 626).

In embodiments, the anti-CD20 antibody includes a heavy chain CDR3 encoded by a nucleotide sequence of CGCAGCACCTATTATGGCGGCGATTGGTCTTGGGCT (SEQ ID NO: 586). In embodiments, the anti-CD20 antibody further includes a heavy chain CDR1 encoded by a nucleotide sequence of TATACCTTCACAAGCTATAAC (SEQ ID NO: 548), and a heavy chain CDR2 encoded by a nucleotide sequence of ATTTATCCGGGCAACGGCGAT (SEQ ID NO: 549). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P08G02 and is further described in the description of Table 3 below. In embodiments, the anti-CD20 antibody is encoded by a nucleic acid sequence that encodes the amino acid sequence of rituximab, except that the heavy chain CDR3 sequence is encoded by a nucleotide sequence of CGCAGCACCTATTATGGCGGCGATTGGTCTTGGGCT (SEQ ID NO: 586).

In embodiments, the anti-CD20 antibody includes a heavy chain CDR3 amino acid sequence of QSIYYGGDWYFN (SEQ ID NO: 622). In embodiments, the anti-CD20 antibody further includes a heavy chain CDR1 amino acid sequence of YTFTSYN (SEQ ID NO: 589), and a heavy chain CDR2 amino acid sequence of IYPGNGD (SEQ ID NO: 590). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P08G02 and is further described in the description of Table 3 below. In embodiments, the anti-CD20 antibody has the amino acid sequence of rituximab, except that the heavy chain CDR3 amino acid sequence is RSTYYGGDWSWA (SEQ ID NO: 627).

In embodiments, the anti-CD20 antibody includes a heavy chain CDR3 encoded by a nucleotide sequence of CGCAGCACCATGTGTAAGGGCGATTGGTATTTTAAC (SEQ ID NO: 587). In embodiments, the anti-CD20 antibody further includes a heavy chain CDR1 encoded by a nucleotide sequence of TATACCTTCACAAGCTATAAC (SEQ ID NO: 548), and a heavy chain CDR2 encoded by a nucleotide sequence of ATTTATCCGGGCAACGGCGAT (SEQ ID NO: 549). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P07A06 and is further described in the description of Table 3 below. In embodiments, the anti-CD20 antibody is encoded by a nucleic acid sequence that encodes the amino acid sequence of rituximab, except that the heavy chain CDR3 sequence is encoded by a nucleotide sequence of CGCAGCACCATGTGTAAGGGCGATTGGTATTTTAAC (SEQ ID NO: 587).

In embodiments, the anti-CD20 antibody includes a heavy chain CDR3 amino acid sequence of RSTMCKGDWYFN (SEQ ID NO: 628)). In embodiments, the anti-CD20 antibody further includes a heavy chain CDR1 amino acid sequence of YTFTSYN (SEQ ID NO: 589), and a heavy chain CDR2 amino acid sequence of IYPGNGD (SEQ ID NO: 590). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P07A06 and is further described in the description of Table 3 below. In embodiments, the anti-CD20 antibody has the amino acid sequence of rituximab, except that the heavy chain CDR3 amino acid sequence is RSTMCKGDWYFN (SEQ ID NO: 628).

In embodiments, the anti-CD20 antibody includes a heavy chain CDR3 encoded by a nucleotide sequence of CGCAGCACCATGTTGGGTGGCGATTGGTATTTTAAC (SEQ ID NO: 588). In embodiments, the anti-CD20 antibody further includes a heavy chain CDR1 encoded by a nucleotide sequence of TATACCTTCACAAGCTATAAC (SEQ ID NO: 548), and a heavy chain CDR2 encoded by a nucleotide sequence of ATTTATCCGGGCAACGGCGAT (SEQ ID NO: 549). In embodiments, the anti-CD20 antibody further includes a light chain CDR1 encoded by a nucleotide sequence of GCGAGCAGCAGCGTGAGC (SEQ ID NO: 630), a light chain CDR2 encoded by a nucleotide sequence of GGAAGCGGCACCAGC (SEQ ID NO: 631), and a light chain CDR3 encoded by a nucleotide sequence of TGGACCAGCAACCCGCCG (SEQ ID NO: 632). In embodiments, this anti-CD20 antibody is referred to as P08E05 and is further described in the description of Table 3 below. In embodiments, the anti-CD20 antibody is encoded by a nucleic acid sequence that encodes the amino acid sequence of rituximab, except that the heavy chain CDR3 sequence is encoded by a nucleotide sequence of CGCAGCACCATGTTGGGTGGCGATTGGTATTTTAAC (SEQ ID NO: 588).

In embodiments, the anti-CD20 antibody includes a heavy chain CDR3 amino acid sequence of RSTMLGGDWYFN (SEQ ID NO: 629) . . . . In embodiments, the anti-CD20 antibody further includes a heavy chain CDR1 amino acid sequence of YTFTSYN (SEQ ID NO: 589), and a heavy chain CDR2 amino acid sequence of IYPGNGD (SEQ ID NO: 590). In embodiments, the anti-CD20 antibody further includes the light chain CDR1 amino acid sequence of ASSSVS (SEQ ID NO: 633), the light chain CDR2 amino acid sequence of GSGTS (SEQ ID NO: 634), and the light chain CDR3 amino acid of WTSNPP (SEQ ID NO: 635). In embodiments, this anti-CD20 antibody is referred to as P08E05 and is further described in the description of Table 3 below. In embodiments, the anti-CD20 antibody has the amino acid sequence of rituximab, except that the heavy chain CDR3 amino acid sequence is RSTMLGGDWYFN (SEQ ID NO: 629).

IV. Expression Systems

In an aspect, provided herein is an isolated nucleic acid encoding a recombinant protein as described herein.

In embodiments, provided herein is an isolated nucleic acid encoding a recombinant protein that includes a Type I transmembrane domain and an immunoglobulin G (IgG) antibody, where the transmembrane domain is fused to the C-terminus of the IgG antibody and where the recombinant protein is resistant to cleavage by a protease. In embodiments, provided herein is isolated nucleic acid encoding a recombinant protein that includes a Type I transmembrane domain and an immunoglobulin G (IgG) antibody, where the transmembrane domain is fused to the C-terminus of the IgG antibody and where the recombinant protein includes an Fc region with a dissociation constant of about $1\times10^{-5}$ M to about $1\times10^{-13}$ M to one or more of CD32 (FcγRII), CD16 (FcγRIII), and CD64 (FcγRI).

In embodiments, provided herein is an expression vector including an isolated nucleic acid encoding a recombinant protein that includes a Type I transmembrane domain and an immunoglobulin G (IgG) antibody, where the transmembrane domain is fused to the C-terminus of the IgG antibody and where the recombinant protein is resistant to cleavage by a protease. In embodiments, provided herein is an expression vector including an isolated nucleic acid encoding a recombinant protein that includes a Type I transmembrane domain and an immunoglobulin G (IgG) antibody, where the transmembrane domain is fused to the C-terminus of the IgG antibody and where the recombinant protein includes an Fc region with a dissociation constant of about $1\times10^{-5}$ M to about $1\times10^{-13}$ M to one or more of CD32 (FcγRII), CD16 (FcγRIII), and CD64 (FcγRI).

In embodiments, provided herein is a cell containing an expression vector as described. Specifically, provided herein is a cell containing an expression vector that includes an isolated nucleic acid encoding a recombinant protein that includes a Type I transmembrane domain and an immunoglobulin G (IgG) antibody, where the transmembrane domain is fused to the C-terminus of the IgG antibody and where the recombinant protein is resistant to cleavage by a protease. Specifically, provided herein is a cell containing an expression vector that includes an isolated nucleic acid encoding a recombinant protein that includes a Type I transmembrane domain and an immunoglobulin G (IgG) antibody, where the transmembrane domain is fused to the C-terminus of the IgG antibody and where the recombinant protein includes an Fc region with a dissociation constant of about $1\times10^{-5}$ M to about $1\times10^{-13}$ M to one or more of CD32 (FcγRII), CD16 (FcγRIII), and CD64 (FcγRI). In embodiments, the cell is a mammalian cell. In embodiments, the mammalian cell is a Chinese hamster ovary (CHO) cell. In embodiments, an IgG antibody encoded by an expression vector as described is expressed on the surface of a cell. In embodiments, an IgG antibody encoded by an expression vector as described is expressed on the surface of a Chinese hamster ovary (CHO) cell.

V. Methods of Use

In an aspect, provided herein are methods of binding a ligand to a cell surface recombinant protein, the method including contacting a ligand with a cell surface recombinant protein, where the cell surface recombinant protein includes a Type I transmembrane domain, an immunoglobulin G (IgG) antibody, where the Type I transmembrane domain is fused to the C-terminus of the IgG antibody, and where the IgG antibody is capable of binding a ligand, and further where the cell surface protein is resistant to cleavage by a protease or has higher binding affinity for one or more of CD32 (FcγRII), CD16 (FcγRIII), and CD64 (FcγRI).

In embodiments of a method of binding a ligand to a cell surface protein, the cell is a CHO cell. In embodiments of a method of binding a ligand to a CHO cell surface protein, the protein is a recombinant protein as described herein. In embodiments of a method of binding a ligand to a CHO cell surface protein, the surface protein is a recombinant protein including a Type I transmembrane domain and an immunoglobulin G (IgG) antibody and where the transmembrane domain is fused to the C-terminus of the IgG antibody. In embodiments of a method of binding a ligand to a CHO cell surface protein, the recombinant protein is resistant to cleavage by a protease. In embodiments of a method of binding a ligand to a CHO cell surface protein, the recombinant protein has higher binding affinity for one or more of CD32 (FcγRII), CD16 (FcγRIII), and CD64 (FcγRI).

In embodiments of a method of binding a ligand to a cell surface protein, the Type I transmembrane domain is capable of dimerization. In embodiments, the Type I transmembrane domain is selected from an EGFR, PDGFR-alpha, PDGFR-beta, HER2, HER3, HER4, FGFR1, FGFR2, FGFR3, FGFR4, VEGFR1, VEGFR2, VEGFR3, Trk-A, Trk-B, Trk-C, and insulin receptor transmembrane domain. In embodiments, the Type I transmembrane domain is an EGFR transmembrane domain. In embodiments, the Type I transmembrane domain is a PDGFR-alpha transmembrane domain. In embodiments, the Type I transmembrane domain is a PDGFR-beta transmembrane domain. In embodiments, the Type I transmembrane domain is an HER2 transmembrane domain. In embodiments, the Type I transmembrane domain is an HER3 transmembrane domain. In embodiments, the Type I transmembrane domain is an HER4 transmembrane domain. In embodiments, the Type I transmembrane domain is an FGFR1 transmembrane domain. In embodiments, the Type I transmembrane domain is an FGFR2 transmembrane domain. In embodiments, the Type I transmembrane domain is an FGFR3 transmembrane domain. In embodiments, the Type I transmembrane domain is an FGFR4 transmembrane domain. In embodiments, the Type I transmembrane domain is a VEGFR1 transmembrane domain. In embodiments, the Type I transmembrane domain is a VEGFR2 transmembrane domain. In embodiments, the Type I transmembrane domain is a VEGFR3 transmembrane domain. In embodiments, the Type I transmembrane domain is a Trk-A transmembrane domain. In embodiments, the Type I transmembrane domain is a Trk-B transmembrane domain. In embodiments, the Type I transmembrane domain is a Trk-C transmembrane domain. In embodiments, the Type I transmembrane domain is an insulin receptor transmembrane domain.

In embodiments of a method of binding a ligand to a cell surface protein, the recombinant protein includes an IgG antibody selected from IgG1, IgG2, IgG3, and IgG4. In embodiments, the IgG antibody is IgG1 antibody. In embodiments, the IgG antibody is IgG2 antibody. In embodiments, the IgG antibody is IgG3 antibody. In embodiments, the IgG antibody is IgG4 antibody.

In embodiments of a method of binding a ligand to a cell surface protein, the IgG antibody includes a protease resistant sequence resistant to cleavage by a protease. In embodiments, the protease is an IgG specific protease. In embodiments, the IgG specific protease is selected from IdeS and IdeZ. In embodiments, the IgG antibody includes a protease resistant sequence resistant to cleavage by IdeS protease. In embodiments, the IgG antibody includes a protease resistant sequence resistant to cleavage by IdeZ protease.

In embodiments of a method of binding a ligand to a cell surface protein, the IgG antibody includes a protease resistant sequence resistant to cleavage by a protease specific for an ELLGGPS amino acid sequence (SEQ ID NO: 544). In embodiments, the ELLGGPS amino acid sequence specific protease, includes but is not limited to, pepsin, matrix metalloproteinase 7 (MMP7), matrix metalloproteinase 3 (MMP3), matrix metalloproteinase (MMP12), cathepsin G, and glutamyl endopeptidase V8 (GluV8). In embodiments, the IgG antibody includes a protease resistant sequence resistant to cleavage by pepsin. In embodiments, the IgG antibody includes a protease resistant sequence resistant to cleavage by matrix metalloproteinase 7 (MMP7). In embodiments, the IgG antibody includes a protease resistant sequence resistant to cleavage by matrix metalloproteinase 3 (MMP3). In embodiments, the IgG antibody includes a protease resistant sequence resistant to cleavage by matrix metalloproteinase (MMP12). In embodiments, the IgG antibody includes a protease resistant sequence resistant to cleavage by cathepsin G. In embodiments, the IgG antibody includes a protease resistant sequence resistant to cleavage by glutamyl endopeptidase V8 (GluV8).

In embodiments of a method of binding a ligand to a CHO cell surface protein, the recombinant protein has higher binding affinity for one or more of CD32 (FcγRII), CD16 (FcγRIII), and CD64 (FcγRI) and the recombinant protein includes an Fc region with a dissociation constant of about $1 \times 10^{-5}$ M to about $1 \times 10^{-13}$ M to one or more of CD32 (FcγRII), CD16 (FcγRIII), and CD64 (FcγRI) as described above.

In an aspect, provided herein is a method of treating cancer in a patient including administering a therapeutic IgG antibody and an IgG specific protease, where the therapeutic IgG antibody is resistant to an IgG specific protease.

Embodiments of the methods of treating cancer include a therapeutic IgG antibody, where the therapeutic IgG antibody for treating cancer is an antibody with any of the antibody characteristics described herein.

Embodiments of the methods of treating cancer include a therapeutic IgG antibody, where the therapeutic IgG antibody includes an IgG antibody selected from IgG1, IgG2, IgG3, and IgG4. In embodiments, the therapeutic IgG antibody is IgG1 antibody. In embodiments, the therapeutic IgG antibody is IgG2 antibody. In embodiments, the therapeutic IgG antibody is IgG3 antibody. In embodiments, the IgG antibody is IgG4 antibody.

Embodiments of the methods of treating cancer include a therapeutic IgG antibody, where the therapeutic IgG antibody includes an Fc (fragment crystallizable) region, a Fab (antigen-binding fragment) region, and a hinge region. In embodiments, the therapeutic IgG antibody includes an Fc (fragment crystallizable) region. In embodiments, the therapeutic IgG antibody includes a Fab (garment crystallizable) region. In embodiments, the therapeutic IgG antibody includes an Fc (antigen-binding fragment) region. In embodiments, the therapeutic IgG antibody includes a hinge region.

Embodiments of the methods of treating cancer include a therapeutic IgG antibody, where the therapeutic IgG antibody includes a Fab region that is identical to the Fab region of any one of Abciximab, Adalimumab, Alemtuzumab, Alemtuzumab, Alirocumab, Arcitumomab, Atezolizumab, Avelumab, Basiliximab, Belimumab, Besilesomab, Bevacizumab, Bevacizumab, Bezlotoxumab, Brentuximab, Brodalumab, Canakinumab, Capromab, Catumaxomab, Certolizumab pegol, Cetuximab, Daratumumab, Denosumab, Dinutuximab, Dupilumab, Durvalumab, Eculizumab, Efalizumab, Elotuzumab, Fanolesomab, Gemtuzumab ozogamicin, Golimumab, Ibritumomab tiuxetan, Idarucizumab, Imiciromab, Infliximab, Ipilimumab, Mepolizumab, Muromonab-CD3, Natalizumab, Necitumumab, Nivolumab, Nofetumomab, Obiltoxaximab, Obinutuzumab, Ocrelizumab, Ofatumumab, Olaratumab, Omalizumab, Palivizumab, Panitumumab, Pembrolizumab, Pertuzumab, Ramucirumab, Ranibizumab, Raxibacumab, Reslizumab, Rituximab, Satumomab, Secukinumab, Siltuximab, Sulesomab, Tocilizumab, Tositumomab, Trastuzumab, Trastuzumab emtansine, Ustekinumab, Vedolizumab, Volocumab, and Votumumab. In embodiments, the therapeutic IgG antibody includes a Fab region that is identical to the Fab region of Abciximab. In embodiments, the therapeutic IgG antibody includes a Fab region that is identical to the Fab region of Adalimumab. In embodiments, the therapeutic IgG antibody includes a Fab region that is identical to the Fab region of Alemtuzumab. In embodiments, the therapeutic IgG antibody includes a Fab region that is identical to the Fab region of Alemtuzumab. In embodiments, the therapeutic IgG antibody includes a Fab region that is identical to the Fab region of Alirocumab. In embodiments, the therapeutic IgG antibody includes a Fab region that is identical to the Fab region of Arcitumomab. In embodiments, the therapeutic IgG antibody includes a Fab region that is identical to the Fab region of Atezolizumab. In embodiments, the therapeutic IgG antibody includes a Fab region that is identical to the Fab region of Avelumab. In embodiments, the therapeutic IgG antibody includes a Fab region that is identical to the Fab region of Basiliximab. In embodiments, the therapeutic IgG antibody includes a Fab region that is identical to the Fab region of Belimumab. In embodiments, the therapeutic IgG antibody includes a Fab region that is identical to the Fab region of Besilesomab. In embodiments, the therapeutic IgG antibody includes a Fab region that is identical to the Fab region of Bevacizumab. In embodiments, the therapeutic IgG antibody includes a Fab region that is identical to the Fab region of Bezlotoxumab. In embodiments, the therapeutic IgG antibody includes a Fab region that is identical to the Fab region of Brentuximab. In embodiments, the therapeutic IgG antibody includes a Fab region that is identical to the Fab region of Brodalumab. In embodiments, the therapeutic IgG antibody includes a Fab region that is identical to the Fab region of Canakinumab. In embodiments, the I therapeutic gG antibody includes a Fab region that is identical to the Fab region of Capromab. In embodiments, the therapeutic IgG antibody includes a Fab region that is identical to the Fab region of Catumaxomab. In embodiments, the therapeutic IgG antibody includes a Fab region that is identical to the Fab region of Certolizumab pegol. In embodiments, the therapeutic IgG antibody includes a Fab region that is identical to the Fab region of Cetuximab. In embodiments, the therapeutic IgG antibody includes a Fab region that is identical to the Fab region of Daratumumab. In embodiments, the therapeutic IgG antibody includes a Fab region that is identical to the Fab region of Denosumab. In embodiments, the therapeutic IgG antibody includes a Fab region that is identical to the Fab region of Dinutuximab. In embodiments, the therapeutic IgG antibody includes a Fab region that is identical to the Fab region of Dupilumab. In embodiments, the therapeutic IgG antibody includes a Fab region that is identical to the Fab region of Durvalumab. In embodiments, the therapeutic IgG antibody includes a Fab region that is identical to the Fab region of Eculizumab. In embodiments, the therapeutic IgG antibody includes a Fab region that is identical to the Fab region of Efalizumab. In embodiments, the therapeutic IgG antibody includes a Fab region that is identical to the Fab region of Elotuzumab. In embodiments, the therapeutic IgG antibody includes a Fab region that is identical to the Fab region of Fanolesomab. In embodiments, the therapeutic IgG antibody includes a Fab region that is identical to the Fab region of Gemtuzumab ozogamicin. In embodiments, the therapeutic IgG antibody includes a Fab region that is identical to the Fab region of Golimumab. In embodiments, the therapeutic IgG antibody includes a Fab region that is identical to the Fab region of Ibritumomab tiuxetan. In embodiments, the therapeutic IgG antibody includes a Fab region that is identical to the Fab region of Idarucizumab. In embodiments, the therapeutic IgG antibody includes a Fab region that is identical to the Fab region of Imiciromab. In embodiments, the therapeutic IgG antibody includes a Fab region that is identical to the Fab region of Infliximab. In embodiments, the therapeutic IgG antibody includes a Fab region that is identical to the Fab region of Ipilimumab. In embodiments, the therapeutic IgG antibody includes a Fab region that is identical to the Fab region of Mepolizumab. In embodiments, the therapeutic IgG antibody includes a Fab region that is identical to the Fab region of Muromonab-CD3. In embodiments, the therapeutic IgG antibody includes a Fab region that is identical to the Fab region of Natalizumab. In embodiments, the therapeutic IgG antibody includes a Fab region that is identical to the Fab region of Necitumumab. In embodiments, the therapeutic IgG antibody includes a Fab region that is identical to the Fab region of Nivolumab. In embodiments, the therapeutic IgG antibody includes a Fab region that is identical to the Fab region of Nofetumomab. In embodiments, the therapeutic IgG antibody includes a Fab region that is identical to the Fab region of Obiltoxaximab. In embodiments, the therapeutic IgG antibody includes a Fab region that is identical to the Fab region of Obinutuzumab. In embodiments, the therapeutic IgG antibody includes a Fab region that is identical to the Fab region of Ocrelizumab. In embodiments, the therapeutic IgG antibody includes a Fab region that is identical to the Fab region of Ofatumumab. In embodiments, the therapeutic IgG antibody includes a Fab region that is identical to the Fab region of Olaratumab. In embodiments, the therapeutic IgG antibody includes a Fab region that is identical to the Fab region of Omalizumab. In embodiments, the therapeutic IgG antibody includes a Fab region that is identical to the Fab region of Palivizumab. In embodiments, the therapeutic IgG antibody includes a Fab region that is identical to the Fab region of Panitumumab. In embodiments, the therapeutic IgG antibody includes a Fab region that is identical to the Fab region of Pembrolizumab. In embodiments, the therapeutic IgG antibody includes a Fab region that is identical to the Fab region of Pertuzumab. In embodiments, the therapeutic IgG antibody includes a Fab region that is identical to the Fab region of Ramucirumab. In embodiments, the therapeutic IgG antibody includes a Fab region that is identical to the Fab region of Ranibizumab. In embodiments, the therapeutic IgG antibody includes a Fab region that is identical to the Fab region of Raxibacumab. In embodiments, the therapeutic IgG antibody includes a Fab region that is identical to the Fab region of Reslizumab. In embodiments, the therapeutic IgG antibody includes a Fab region that is identical to the Fab region of Rituximab. In embodiments, the therapeutic IgG antibody includes a Fab region that is identical to the Fab region of Satumomab. In embodiments, the therapeutic IgG antibody includes a Fab region that is identical to the Fab region of Secukinumab. In embodiments, the therapeutic IgG antibody includes a Fab region that is identical to the Fab region of Siltuximab. In embodiments, the therapeutic IgG antibody includes a Fab region that is identical to the Fab region of Sulesomab. In embodiments, the therapeutic IgG antibody includes a Fab region that is identical to the Fab region of Tocilizumab. In embodiments, the therapeutic IgG antibody includes a Fab region that is identical to the Fab region of Tositumomab. In embodiments, the therapeutic IgG antibody includes a Fab region that is identical to the Fab region of Trastuzumab. In embodiments, the therapeutic IgG antibody includes a Fab region that is identical to the Fab region of Trastuzumab emtansine. In embodiments, the therapeutic IgG antibody includes a Fab region that is identical to the Fab region of Ustekinumab. In embodiments, the therapeutic IgG antibody includes a Fab region that is identical to the Fab region of Vedolizumab. In embodiments, the therapeutic IgG antibody includes a Fab region that is identical to the Fab region of Volocumab. In embodiments, the therapeutic IgG antibody includes a Fab region that is identical to the Fab region of Votumumab.

Embodiments of the methods of treating cancer include a therapeutic IgG antibody, where the therapeutic IgG antibody includes a hinge region that includes a protease resistant sequence. In embodiments, the sequence is between amino acid positions 246-252 according to Kabat numbering. In embodiments, the sequence is between positions corresponding to Kabat positions 246-252. In embodiments, the protease resistant sequence is two or more amino acids in length. In embodiments, the protease resistant sequence is three amino acids in length. In embodiments, the protease resistant sequence is four amino acids in length. In embodiments, the protease resistant sequence is five amino acids in length. In embodiments, the protease resistant sequence is six amino acids in length. In embodiments, the protease resistant sequence is seven amino acids in length. In embodiments, the protease resistant sequence includes the amino acids of SEQ ID NO: 546. In embodiments, the protease resistant sequence includes the amino acids of SEQ ID NO: 545. In embodiments, the protease resistant sequence includes the amino acids of SEQ ID NO: 547.

Embodiments of the methods of treating cancer include a therapeutic IgG antibody, where the therapeutic IgG antibody hinge region is two amino acids in length and includes an amino acid sequence of DW, YD, QW, QE, PW, QD, or DD. In embodiments, the therapeutic IgG antibody hinge region is three amino acids in length and includes an amino acid sequence of XDW, XDW, XYD, XQW, XQE, XPW, XQD, or XDD, where X is any amino acid. In embodiments, the therapeutic IgG antibody hinge region is four amino acids in length and includes an amino acid sequence of XXDW, XXDW, XXYD, XXQW, XXQE, XXPW, XXQD, or XXDD, where X is any amino acid. In embodiments, the therapeutic IgG antibody hinge region is five amino acids in length and includes an amino acid sequence of XXXDW, XXXYD, XXXQW, XXXQE, XXXPW, XXXQD, or XXXDD, where X is any amino acid. In embodiments, the therapeutic IgG antibody hinge region is six amino acids in length and includes an amino acid sequence of XXXXDW, XXXXYD, XXXXQW, XXXXQE, XXXXPW, XXXXQD, or XXXXDD, where X is any amino acid. In embodiments, the therapeutic IgG antibody hinge region is seven amino acids in length and includes an amino acid sequence of XXXXXDW, XXXXXYD, XXXXXQW, XXXXXQE, XXXXXPW, XXXXXQD, or XXXXXDD, where X is any amino acid. In embodiments, the therapeutic IgG antibody hinge region is eight amino acids in length and includes an amino acid sequence of XXXXXXDW, XXXXXXYD, XXXXXXQW, XXXXXXQE, XXXXXXPW, XXXXXXQD, or XXXXXXDD, where X is any amino acid. In embodiments, the therapeutic IgG antibody hinge region is nine amino acids in length and includes an amino acid sequence of XXXXXXXDW, XXXXXXXYD, XXXXXXXQW, XXXXXXXQE, XXXXXXXPW, XXXXXXXQD, or XXXXXXXDD, where X is any amino acid. In embodiments, the therapeutic IgG antibody hinge region includes an amino acid sequence of XCWDW (SEQ ID NO:649), XXCWDW (SEQ ID NO:650), XXXCWDW (SEQ ID NO:651), XXXXXCWDW (SEQ ID NO: 652), XXXXXXCWDW (SEQ ID NO:653), XXXXXXXCWDW (SEQ ID NO:654), ETCWDW (SEQ ID NO:647), DSCWDW (SEQ ID NO:646), YDCWDW (SEQ ID NO:645), DDCWDW (SEQ ID NO:644), DMCWDW (SEQ ID NO:643), EHCWDW (SEQ ID NO:642), IICWDW (SEQ ID NO:641), DVCWDW (SEQ ID NO:640), EFCWDW (SEQ ID NO:639), FNCWDW (SEQ ID NO:638), EETCWDW (SEQ ID NO:545), EDSCWDW (SEQ ID NO:546), EETCWDD (SEQ ID NO:637), or EETQWDD (SEQ ID NO:636) where X is any amino acid.

Embodiments of the methods of treating cancer include a therapeutic IgG antibody, where the therapeutic IgG antibody includes a hinge region that includes DW, YD, QW, QE, PW, QD, DD, CWDW (SEQ ID NO:648), ETCWDW (SEQ ID NO:647), DSCWDW (SEQ ID NO:646), YDCWDW (SEQ ID NO:645), DDCWDW (SEQ ID NO:644), DMCWDW (SEQ ID NO:643), EHCWDW (SEQ ID NO:642), IICWDW (SEQ ID NO:641), DVCWDW (SEQ ID NO:640), EFCWDW (SEQ ID NO:639), FNCWDW (SEQ ID NO:638), EETCWDW (SEQ ID NO: 545), EDSCWDW (SEQ ID NO: 546), EETCWDD (SEQ ID NO:637), EETCWSW (SEQ ID NO: 547), EETQWDD (SEQ ID NO:636). In some aspects, the variants or homologs have one, two, three, four, five or six amino acid sequence identity.

Embodiments of the methods of treating cancer include a therapeutic IgG antibody, where the therapeutic IgG antibody includes a protease resistant sequence resistant to cleavage by a protease. In embodiments, the protease is an IgG specific protease. In embodiments, the IgG specific protease is selected from IdeS and IdeZ. In embodiments, the therapeutic IgG antibody includes a protease resistant sequence resistant to cleavage by IdeS protease. In embodiments, the therapeutic IgG antibody includes a protease resistant sequence resistant to cleavage by IdeZ protease.

Embodiments of the methods of treating cancer include a therapeutic IgG antibody, where the therapeutic IgG antibody includes a protease resistant sequence resistant to cleavage by a protease specific for an ELLGGPS amino acid sequence (SEQ ID NO: 544). In embodiments, the ELLGGPS amino acid sequence (SEQ ID NO:544) specific protease, includes but is not limited to, pepsin, matrix metalloproteinase 7 (MMP7), matrix metalloproteinase 3 (MMP3), matrix metalloproteinase (MMP12), cathepsin G, and glutamyl endopeptidase V8 (GluV8). In embodiments, the therapeutic IgG antibody includes a protease resistant sequence resistant to cleavage by pepsin. In embodiments, the therapeutic IgG antibody includes a protease resistant sequence resistant to cleavage by matrix metalloproteinase 7 (MMP7). In embodiments, the therapeutic IgG antibody includes a protease resistant sequence resistant to cleavage by matrix metalloproteinase 3 (MMP3). In embodiments, the therapeutic IgG antibody includes a protease resistant sequence resistant to cleavage by matrix metalloproteinase (MMP12). In embodiments, the therapeutic IgG antibody includes a protease resistant sequence resistant to cleavage by cathepsin G. In embodiments, the therapeutic IgG antibody includes a protease resistant sequence resistant to cleavage by glutamyl endopeptidase V8 (GluV8).

Embodiments of the methods of treating cancer include a therapeutic IgG antibody, where the Fc region of the therapeutic IgG antibody has a dissociation constant of about $1\times10^{-5}$ M to about $1\times10^{-13}$ M to one or more of CD20, CD32 (FcγRII), CD16 (FcγRIII), and CD64 (FcγRI). RI). In embodiments, the Fc region of the therapeutic IgG antibody has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{-6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$ M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M, about $1\times10^{-8}$M to about $1\times10^{-11}$ M, about $1\times10^{-8}$ M to about $1\times10^{-10}$ M, about $1\times10^{-8}$ M to about $1\times10^{-9}$ M, about $1\times10^{-9}$M to about $1\times10^{-13}$ M, about $1\times10^{-9}$M to about $1\times10^{-12}$ M, about $1\times10^{-9}$M to about $1\times10^{-11}$ M, about $1\times10^{-9}$ M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to one or more of CD32 (FcγRII), CD16 (FcγRIII), and CD64 (FcγRI). In embodiments, the therapeutic IgG antibody has a dissociation constant of about $1\times10^{-5}$ M, about $1\times10^{-6}$ M, about $1\times10^{-7}$ M, about $1\times10^{-8}$ M, about $1\times10^{-9}$M, about $1\times10^{-10}$ M, about $1\times10^{-11}$ M, about $1\times10^{-12}$ M, or about $1\times10^{-13}$ M to one or more of CD32 (FcγRII), CD16 (FcγRIII), and CD64 (FcγRI).

Embodiments of the methods of treating cancer include a therapeutic IgG antibody, where the Fc region of the therapeutic IgG antibody has a dissociation constant of about $1\times10^{-5}$ M to about $1\times10^{-13}$ M to CD32 (FcγRII). In embodiments, the Fc region of the therapeutic IgG antibody has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$M to about $1\times10^{-11}$ M, about $1\times10^{-6}$ M to about $1\times10^{-10}$ M, about $1\times10^{-6}$M to about $1\times10^{-9}$ M, about $1\times10^{-6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$ M to about $1\times10^{-10}$ M, about $1\times10^{-7}$M to about $1\times10^{-9}$ M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$M to about $1\times10^{-9}$ M, about $1\times10^{-9}$ M to about $1\times10^{-13}$ M, about $1\times10^{-9}$M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD32 (FcγRII). In embodiments, the Fc region of the therapeutic IgG antibody has a dissociation constant of about $1\times10^{-5}$ M, about $1\times10^{-6}$M, about $1\times10^{-7}$M, about $1\times10^{-8}$ M, about $1\times10^{-9}$M, about $1\times10^{-10}$ M, about $1\times10^{-11}$ M, about $1\times10^{-12}$ M, or about $1\times10^{-13}$ M to CD32 (FcγRII). In embodiments, the therapeutic IgG antibody has a disso-ciation constant of about $1\times10^{-5}$ M to CD32 (FcγRII). In embodiments, the Fc region of the therapeutic IgG antibody has a dissociation constant of about $1\times10^{-6}$ M to CD32 (FcγRII). In embodiments, the Fc region of the therapeutic IgG antibody has a dissociation constant of about $1\times10^{-7}$M to CD32 (FcγRII). In embodiments, the Fc region of the therapeutic IgG antibody has a dissociation constant of about $1\times10^{-8}$ M to CD32 (FcγRII). In embodiments, the Fc region of the therapeutic IgG antibody has a dissociation constant of about $1\times10^{-9}$ M to CD32 (FcγRII). In embodi-ments, the Fc region of the therapeutic IgG antibody has a dissociation constant of about $1\times10^{-10}$ M to CD32 (FcγRII). In embodiments, the Fc region of the therapeutic IgG antibody has a dissociation constant of about $1\times10^{-11}$ M to CD32 (FcγRII). In embodiments, the Fc region of the therapeutic IgG antibody has a dissociation constant of about $1\times10^{-12}$ M to CD32 (FcγRII). In embodiments, the Fc region of the therapeutic IgG antibody has a dissociation constant of about $1\times10^{-13}$ M to CD32 (FcγRII).

Embodiments of the methods of treating cancer include a therapeutic IgG antibody, where the Fc region of the thera-peutic IgG antibody has a dissociation constant of about $1\times10^{-5}$ M to about $1\times10^{-13}$ M to CD16 (FcγRIII). In embodiments, the therapeutic IgG antibody has a dissocia-tion constant of about $1\times10^{-5}$ M to about $1\times10^{-13}$ M to CD16 (FcγRIII). In embodiments, the Fc region of the therapeutic IgG antibody has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$ M to about $1\times10^{-9}$ M, about $1\times10^{6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$ M to about $1\times10^{-11}$ M, about $1\times10^{-7}$M to about $1\times10^{-10}$ M, about $1\times10^{-7}$M to about $1\times10^{-9}$ M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-9}$ M, about $1\times10^{-9}$M to about $1\times10^{-13}$ M, about $1\times10^{-9}$M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD16 (FcγRIII). In embodiments, the Fc region of the therapeutic IgG antibody has a dissociation constant of about $1\times10^{-5}$ M, about $1\times10^{-6}$M, about $1\times10^{-7}$M, about $1\times10^{-8}$ M, about $1\times10^{-9}$M, about $1\times10^{-10}$ M, about $1\times10^{-11}$ M, about $1\times10^{-12}$ M, or about $1\times10^{-13}$ M to CD16 (FcγRIII). In embodiments, the Fc region of the therapeutic IgG antibody has a dissociation constant of about $1\times10^{-5}$ M to CD16 (FcγRIII). In embodiments, the Fc region of the therapeutic IgG antibody has a dissociation constant of about $1\times10^{-6}$ M to CD16 (FcγRIII). In embodiments, the Fc region of the therapeutic IgG antibody has a dissociation constant of about $1\times10^{-7}$M to CD16 (FcγRIII). In embodiments, the Fc region of the therapeutic IgG antibody has a dissociation constant of about $1\times10^{-8}$ M to CD16 (FcγRIII). In embodi-ments, the Fc region of the therapeutic IgG antibody has a dissociation constant of about $1\times10^{-9}$ M to CD16 (FcγRIII). In embodiments, the Fc region of the therapeutic IgG antibody has a dissociation constant of about $1\times10^{-10}$ M to CD16 (FcγRIII). In embodiments, the Fc region of the therapeutic IgG antibody has a dissociation constant of about $1\times10^{-11}$ M to CD16 (FcγRIII). In embodiments, the Fc region of the therapeutic IgG antibody has a dissociation constant of about $1\times10^{-12}$ M to CD16 (FcγRIII). In embodi-ments, the Fc region of the therapeutic IgG antibody has a dissociation constant of about $1\times10^{-13}$ M to CD16 (FcγRIII).

Embodiments of the methods of treating cancer include a therapeutic IgG antibody, where the Fc region of the thera-peutic IgG antibody has a dissociation constant of about $1\times10^{-5}$ M to about $1\times10^{-13}$ M to CD64 (FcγRI). In embodi-ments, the Fc region of the therapeutic IgG antibody has a dissociation constant of about $1\times10^{-5}$ M to about $1\times10^{-13}$ M to CD64 (FcγRI). In embodiments, the Fc region of the therapeutic IgG antibody has a dissociation constant of about $1\times10^{-5}$ M to about $1\times10^{-12}$ M, about $1\times10^{-5}$ M to about $1\times10^{-11}$ M, about $1\times10^{-5}$ M to about $1\times10^{-10}$ M, about $1\times10^{-5}$ M to about $1\times10^{-9}$ M, about $1\times10^{-5}$ M to about $1\times10^{-8}$ M, about $1\times10^{-5}$ M to about $1\times10^{-7}$ M, about $1\times10^{-5}$ M to about $1\times10^{-6}$ M, about $1\times10^{-6}$ M to about $1\times10^{-13}$ M, about $1\times10^{-6}$ M to about $1\times10^{-12}$ M, about $1\times10^{-6}$ M to about $1\times10^{-11}$ M, about $1\times10^{-6}$ M to about $1\times10^{-10}$ M, about $1\times10^{-6}$M to about $1\times10^{-9}$ M, about $1\times10^{-6}$ M to about $1\times10^{-8}$ M, about $1\times10^{-6}$ M to about $1\times10^{-7}$ M, about $1\times10^{-7}$M to about $1\times10^{-13}$ M, about $1\times10^{-7}$M to about $1\times10^{-12}$ M, about $1\times10^{-7}$M to about $1\times10^{-11}$ M, about $1\times10^{-7}$M to about $1\times10^{-10}$ M, about $1\times10^{-7}$M to about $1\times10^{-9}$ M, about $1\times10^{-7}$M to about $1\times10^{-8}$ M, about $1\times10^{-8}$ M to about $1\times10^{-13}$ M, about $1\times10^{-8}$ M to about $1\times10^{-12}$ M, about $1\times10^{-8}$ M to about $1\times10^{-11}$ M, about $1\times10^{-8}$ M to about $1\times10^{-10}$ M, about $1\times10^{-8}$ M to about $1\times10^{-9}$ M, about $1\times10^{-9}$M to about $1\times10^{-13}$ M, about $1\times10^{-9}$ M to about $1\times10^{-12}$ M, about $1\times10^{-9}$M to about $1\times10^{-11}$ M, about $1\times10^{-9}$M to about $1\times10^{-10}$ M, about $1\times10^{-10}$ M to about $1\times10^{-13}$ M, about $1\times10^{-10}$ M to about $1\times10^{-12}$ M, about $1\times10^{-10}$ M to about $1\times10^{-11}$ M, about $1\times10^{-11}$ M to about $1\times10^{-13}$ M, about $1\times10^{-11}$ M to about $1\times10^{-12}$ M, or about $1\times10^{-12}$ M to about $1\times10^{-13}$ M to CD64 (FcγRI). In embodiments, the Fc region of the therapeutic IgG antibody has a dissociation constant of about $1\times10^{-5}$ M, about $1\times10^{-6}$M, about $1\times10^{-7}$M, about $1\times10^{-8}$ M, about $1\times10^{-9}$M, about $1\times10^{-10}$ M, about $1\times10^{-11}$ M, about $1\times10^{-12}$ M, or about $1\times10^{-13}$ M to CD64 (FcγRI).

In embodiments, the Fc region of the therapeutic IgG antibody has a dissociation constant of about $1\times10^{-5}$ M to CD64 (FcγRI). In embodiments, t the Fc region of the therapeutic IgG antibody has a dissociation constant of about $1\times10^{-6}$ M to CD64 (FcγRI). In embodiments, the Fc region of the therapeutic IgG antibody has a dissociation constant of about $1\times10^{-7}$M to CD64 (FcγRI). In embodiments, the Fc region of the therapeutic IgG antibody has a dissociation constant of about $1\times10^{-8}$ M to CD64 (FcγRI). In embodiments, the Fc region of the therapeutic IgG antibody has a dissociation constant of about $1\times10^{-9}$ M to CD64 (FcγRI). In embodiments, the Fc region of the therapeutic IgG antibody has a dissociation constant of about $1\times10^{-10}$ M to CD64 (FcγRI). In embodiments, the Fc region of the therapeutic IgG antibody has a dissociation constant of about $1\times10^{-11}$ M to CD64 (FcγRI). In embodiments, the Fc region of the therapeutic IgG antibody has a dissociation constant of about $1\times10^{-12}$ M to CD64 (FcγRI). In embodiments, the Fc region of the therapeutic IgG antibody has a dissociation constant of about $1\times10^{-13}$ M to CD64 (FcγRI).

In an aspect, provided herein are methods of enhancing efficacy of therapeutic IgG antibody in a subject including mutating the hinge region of a therapeutic IgG antibody to produce a variant of the therapeutic IgG antibody that is resistant to a protease according to any of the various embodiments described herein.

In embodiments of a method of enhancing efficacy of therapeutic IgG antibody in a subject, the therapeutic IgG antibody is resistant to a protease, where the protease is an IgG specific protease. In embodiments, the IgG specific protease is selected from IdeS and IdeZ. In embodiments, the IgG specific protease is IdeS protease. In embodiments, the IgG specific protease is IdeZ protease. In embodiments, the protease is specific for an ELLGGPS amino acid sequence (SEQ ID NO: 544). In embodiments, the ELLGGPS amino acid sequence (SEQ ID NO: 544) specific protease is selected from pepsin, matrix metalloproteinase 7 (MMP7), matrix metalloproteinase 3 (MMP3), matrix metalloproteinase (MMP12), cathepsin G, and glutamyl endopeptidase V8 (GluV8). In embodiments, the ELLGGPS amino acid sequence specific (SEQ ID NO: 544) protease is pepsin. In embodiments, the ELLGGPS amino acid sequence (SEQ ID NO: 544) specific protease is matrix metalloproteinase 7 (MMP7). In embodiments, the ELLGGPS amino acid sequence (SEQ ID NO: 544) specific protease is matrix metalloproteinase 3 (MMP3). In embodiments, the ELLGGPS amino acid sequence (SEQ ID NO: 544) specific protease is matrix metalloproteinase (MMP12). In embodiments, the ELLGGPS amino acid sequence (SEQ ID NO: 544) specific protease is cathepsin G. In embodiments, the ELLGGPS amino acid sequence (SEQ ID NO: 544) specific protease is glutamyl endopeptidase V8 (GluV8).

In embodiments of a method of enhancing efficacy of therapeutic IgG antibody in a subject, the therapeutic IgG antibody is any antibody as described above and herein. Further, the therapeutic IgG antibody is an antibody selected from Herceptin and any other IgG therapeutic mAb that relies on the Fc region of the IgG antibody binding to FcγR of any innate immune cell (e.g., NK cells, monocytes, macrophages, dendritic cells, and granulocytes) for its efficacy.

Further disclosed herein are methods of using proteins, antibodies, fusion proteins, antibody fragments, antigens and Chinese Hamster Ovary (CHO) cells as described herein. In some embodiments, the methods relate to using proteins, antibodies, fusion proteins, antibody fragments, antigens and CHO cells for rapid optimization of an antibody-antigen interactions via affinity selection. In some embodiments, the methods relate to using proteins, antibodies, fusion proteins, antibody fragments, antigens and CHO cells as described herein to improve efficacy of a therapeutic antibody where a portion or full therapeutic effect is mediated via ADCC or ADCP.

In an aspect, provided herein are methods of generating an IgG antibody with a hinge region resistant to an IgG specific protease.

In an aspect, provided herein are methods of generating an IgG antibody with a hinge region able to bind CD32 (FcγRII), CD16 (FcγRIII), and CD64 (FcγRI) with higher affinity.

In an aspect, provided herein are methods of generating an IgG antibody with a hinge region able to bind CD32 (FcγRII), CD16 (FcγRIII), and CD64 (FcγRI) with lower affinity.

In an aspect, provided herein are methods of generating an IgG antibody with hinge regions that are resistant to the IgG specific protease and are able to bind CD32 (FcγRII), CD16 (FcγRIII), and CD64 (FcγRI) with higher affinity In an aspect, provided herein are methods of generating an IgG antibody with hinge regions that are resistant to the IgG specific protease and are able to bind CD32 (FcγRII), CD16 (FcγRIII), and CD64 (FcγRI) with lower affinity.

In an aspect, provided herein are methods of generating an IgG antibody with varied affinity to its specific antigen.

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

P-EMBODIMENTS

Embodiment P-1. An immunoglobulin G (IgG) antibody comprising a Fab region and an Fc region connected through a hinge region, wherein the hinge region is resistant to cleavage by a protease.

Embodiment P-2. The IgG antibody of Embodiment 1, wherein the IgG antibody is an IgG1 antibody, an IgG2 antibody, an IgG3 antibody, or an IgG4 antibody.

Embodiment P-3. The IgG antibody of any one of Embodiments 1-2, wherein the IgG antibody is an IgG1 antibody.

Embodiment P-4. The IgG antibody of any one of Embodiments 1-2, wherein the IgG antibody is an IgG2 antibody.

Embodiment P-5. The IgG antibody of any one of Embodiments 1-2, wherein the IgG antibody is an IgG3 antibody.

Embodiment P-6. The IgG antibody of any one of Embodiments 1-2, wherein the IgG antibody is an IgG4 antibody.

Embodiment P-7. The IgG antibody of Embodiment 6, wherein the hinge region comprises a protease resistant sequence between amino acid positions 246-252 according to the EU numbering of Kabat.

Embodiment P-8. The IgG antibody of Embodiment 7, wherein the protease resistant sequence is 2 or more amino acids in length.

Embodiment P-9. The IgG antibody of Embodiment 7, wherein the protease resistant sequence is 3 amino acids in length.

Embodiment P-10. The IgG antibody of Embodiment 7, wherein the protease resistant sequence is 4 amino acids in length.

Embodiment P-11. The IgG antibody of Embodiment 7, wherein the protease resistant sequence is 5 amino acids in length.

Embodiment P-12. The IgG antibody of Embodiment 7, wherein the protease resistant sequence is 6 amino acids in length.

Embodiment P-13. The IgG antibody of Embodiment 7, wherein the protease resistant sequence is 7 amino acids in length.

Embodiment P-14. The IgG antibody of Embodiment 7, wherein the protease resistant sequence comprises the amino acids of SEQ ID NO: 545.

Embodiment P-15. The IgG antibody of any one of Embodiments 1-14, wherein the Fc region has a dissociation constant of about $1 \times 10^{-5}$ M to about $1 \times 10^{-13}$ M to one or more of CD32 (FcγRII), CD16 (FcγRIII), and CD64 (FcγRI).

Embodiment P-16. The IgG antibody of any one of Embodiments 1-15, wherein the Fc region has a dissociation constant of about $1 \times 10^{-5}$ M to about $1 \times 10^{-13}$ M to CD32.

Embodiment P-17. The IgG antibody of any one of Embodiments 1-16, wherein the Fc region has a dissociation constant of about $1 \times 10^{-5}$ M to about $1 \times 10^{-13}$ M to CD16.

Embodiment P-18. The IgG antibody of any one of Embodiments 1-17, wherein the Fc region has a dissociation constant of about $1 \times 10^{-5}$ M to about $1 \times 10^{-13}$ M to CD64.

Embodiment P-19. The IgG antibody of any one of Embodiments 1-18, wherein the protease is an IgG specific protease.

Embodiment P-20. The IgG antibody of Embodiment 19, wherein the IgG specific protease is selected from IdeS and IdeZ Embodiment P-21. The IgG antibody of Embodiment 20, wherein the protease is IdeS.

Embodiment P-22. The IgG antibody of Embodiment 20, wherein the protease is IdeZ.

Embodiment P-23. The IgG antibody of any one of Embodiments 1-18, wherein the protease is selected from pepsin, matrix metalloproteinase 7 (MMP7), matrix metalloproteinase 3 (MMP3), matrix metalloproteinase (MMP12), cathepsin G, and glutamyl endopeptidase V8 (GluV8).

Embodiment P-24. An immunoglobulin G (IgG) antibody, wherein the antibody comprises a Fab region and an Fc region connected through a hinge region, wherein the Fc region has a dissociation constant of about $1 \times 10^{-5}$ M to about $1 \times 10^{-13}$ M to one or more of CD32 (FcγRII), CD16 (FcγRIII), and CD64 (FcγRI).

Embodiment P-25. The IgG antibody of Embodiment 24, wherein the Fc region comprises one or more amino acid substitutions conferring higher binding affinity for one or more of CD32 (FcγRII), CD16 (FcγRIII), and CD64 (FcγRI) compared to a wild type Fc.

Embodiment P-26. The IgG antibody of Embodiment 25, wherein the Fc region comprises an amino acid substitution selected from S252D, I351E, and A349L according to the EU numbering of Kabat and wherein the substitution confers higher binding affinity for CD16 (FcγRIII) compared to wild type.

Embodiment P-27. The IgG antibody of Embodiment 26, wherein the Fc region comprises amino acid substitution S252D.

Embodiment P-28. The IgG antibody of Embodiment 26, wherein the Fc region comprises amino acid substitution I351E.

Embodiment P-29. The IgG antibody of Embodiment 26, wherein the Fc region comprises amino acid substitutions S252D and I351E.

Embodiment P-30. The IgG antibody of Embodiment 26, wherein the Fc region comprises amino acid substitutions S252D, I351E, and A349.

Embodiment P-31. The IgG antibody of any one of Embodiments 24 or 25, wherein the Fc region has a dissociation constant of about $1 \times 10^{-5}$ M to about $1 \times 10^{-13}$ M to CD32.

Embodiment P-32. The IgG antibody of any one of Embodiments 24-30, wherein the Fc region has a dissociation constant of about $1 \times 10^{-5}$ M to about $1 \times 10^{-13}$ M to CD16.

Embodiment P-33. The IgG antibody of any one of Embodiments 24 or 25, wherein the Fc region has a dissociation constant of about $1 \times 10^{-5}$ M to about $1 \times 10^{-13}$ M to CD64.

Embodiment P-34. The IgG antibody of any one of Embodiments 24-33, wherein the antibody is resistant to protease cleavage.

Embodiment P-35. The IgG antibody of Embodiment 34, wherein the protease is an IgG specific protease.

Embodiment P-36. The IgG antibody of Embodiment 35, wherein the IgG specific protease is IdeS.

Embodiment P-37. The IgG antibody of Embodiment 35, wherein the IgG specific protease is IdeZ.

Embodiment P-38. The IgG antibody of Embodiment 34, wherein the protease is selected from pepsin, matrix metalloproteinase 7 (MMP7), matrix metalloproteinase 3 (MMP3), matrix metalloproteinase (MMP12), cathepsin G, and glutamyl endopeptidase V8 (GluV8).

Embodiment P-39. The IgG antibody of any one of Embodiments 34-38, wherein the hinge region comprises a protease resistant sequence at amino acid positions 246-252 according to the EU numbering of Kabat and that is 2 or more amino acids in length.

Embodiment P-40. The IgG antibody of Embodiment 39, wherein the protease resistant sequence is 3 amino acids in length.

Embodiment P-41. The IgG antibody of Embodiment 39, wherein the protease resistant sequence is 4 amino acids in length.

Embodiment P-42. The IgG antibody of Embodiment 39, wherein the protease resistant sequence is 5 amino acids in length.

Embodiment P-43. The IgG antibody of Embodiment 39, wherein the protease resistant sequence is 6 amino acids in length.

Embodiment P-44. The IgG antibody of Embodiment 39, wherein the protease resistant sequence is 7 amino acids in length.

Embodiment P-45. The IgG antibody of Embodiment 39, wherein the hinge region comprises the amino acids of SEQ ID NO: 545.

Embodiment P-46. A recombinant protein comprising:
a Type I transmembrane domain; and
b. an immunoglobulin G (IgG) antibody;
wherein the transmembrane domain is fused to the C-terminus of the IgG antibody; and wherein the recombinant protein is resistant to cleavage by a protease.

Embodiment P-47. The recombinant protein of Embodiment 46, wherein the Type I transmembrane domain is capable of dimerization.

Embodiment P-48. The recombinant protein of Embodiment 46 or 47, wherein the Type I transmembrane domain is selected from an EGFR, PDGFR-alpha, PDGFR-beta, HER2, HER3, HER4, FGFR1, FGFR2, FGFR3, FGFR4, VEGFR1, VEGFR2, VEGFR3, Trk-A, Trk-B, Trk-C, and insulin receptor transmembrane domain.

Embodiment P-49. The recombinant protein of any one of Embodiments 46-48, wherein the Type I transmembrane domain is an EGFR transmembrane domain.

Embodiment P-50. The recombinant protein of any one of Embodiments 46-49, wherein the IgG antibody is an IgG1 antibody, an IgG2 antibody, an IgG3 antibody, or an IgG4 antibody.

Embodiment P-51. The recombinant protein of any one of Embodiments 46-49, wherein the IgG domain is an IgG1 antibody.

Embodiment P-52. The recombinant protein of any one of Embodiments 46-49, wherein the IgG domain is an IgG2 antibody.

Embodiment P-53. The recombinant protein of any one of Embodiments 46-49, wherein the IgG domain is an IgG3 antibody.

Embodiment P-54. The recombinant protein of any one of Embodiments 46-49, wherein the IgG domain is an IgG4 antibody.

Embodiment P-55. The recombinant protein of any one of Embodiments 46-54, wherein the IgG antibody comprises an Fc (fragment crystallizable) region, a Fab (antigen-binding fragment) region, and a hinge region.

Embodiment P-56. The recombinant protein of Embodiment 55, wherein the IgG antibody comprises an Fc region.

Embodiment P-57. The recombinant protein of Embodiment 55, wherein the IgG antibody comprises a hinge region.

Embodiment P-58. The recombinant protein of any one of Embodiments 55-57, wherein the hinge region comprises a protease resistant sequence between amino acid positions 246-252 according to the EU numbering of Kabat and that is 2 or more amino acids in length.

Embodiment P-59. The recombinant protein of Embodiment 58, wherein the protease resistant sequence is 3 amino acids in length.

Embodiment P-60. The recombinant protein of Embodiment 58, wherein the protease resistant sequence is 4 amino acids in length.

Embodiment P-61. The recombinant protein of Embodiment 58, wherein the protease resistant sequence is 5 amino acids in length.

Embodiment P-62. The recombinant protein of Embodiment 58, wherein the protease resistant sequence is 6 amino acids in length.

Embodiment P-63. The recombinant protein of Embodiment 58, wherein the protease resistant sequence is 7 amino acids in length.

Embodiment P-64. The recombinant protein of Embodiment 58, wherein the hinge region comprises the amino acids of SEQ ID NO: 545.

Embodiment P-65. The recombinant protein of any one of Embodiments 46-64, wherein the recombinant protein comprises an Fc region with a dissociation constant of about $1\times10^{-5}$ M to about $1\times10^{-13}$ M to one or more of CD32 (FcγRII), CD16 (FcγRIII), and CD64 (FcγRI).

Embodiment P-66. The recombinant protein of any one of Embodiments 46-65, wherein the recombinant protein comprises an Fc region with a dissociation constant of about $1\times10^{-5}$ M to about $1\times10^{-13}$ M to CD32.

Embodiment P-67. The recombinant protein of any one of Embodiments 46-66, wherein the recombinant protein comprises an Fc region with a dissociation constant of about $1\times10^{-5}$ M to about $1\times10^{-13}$ M to CD16.

Embodiment P-68. The recombinant protein of any one of Embodiments 46-67, wherein the recombinant protein comprises an Fc region with a dissociation constant of about $1\times10^{-5}$ M to about $1\times10^{-13}$ M to CD64.

Embodiment P-69. The recombinant protein of any one of Embodiments 46-68, wherein the protease is an IgG specific protease.

Embodiment P-70. The recombinant protein of Embodiment 69, wherein the IgG specific protease is selected from IdeS and IdeZ.

Embodiment P-71. The recombinant protein of Embodiment 70, wherein the IgG specific protease is IdeS.

Embodiment P-72. The recombinant protein of Embodiment 70, wherein the IgG specific protease is IdeZ.

Embodiment P-73. The recombinant protein of Embodiment 69, wherein the protease is selected from pepsin, matrix metalloproteinase 7 (MMP7), matrix metalloproteinase 3 (MMP3), matrix metalloproteinase (MMP12), cathepsin G, and glutamyl endopeptidase V8 (GluV8).

Embodiment P-74. A recombinant protein comprising:
a. a Type I-transmembrane domain; and
b. an immunoglobulin G (IgG) antibody;
wherein the transmembrane domain is fused to the C-terminus of the IgG antibody; and
wherein the recombinant protein comprises an Fc region with a dissociation constant of about $1\times10^{-5}$ M to about $1\times10^{-13}$ M to one or more of CD32 (FcγRII), CD16 (FcγRIII), and CD64 (FcγRI).

Embodiment P-75. The recombinant protein of Embodiment 74, wherein the Type I transmembrane domain is capable of dimerization.

Embodiment P-76. The recombinant protein of any one of Embodiments 74 or 75, wherein the Type I transmembrane domain is selected from an EGFR, PDGFR-alpha, PDGFR-beta, HER2, HER3, HER4, FGFR1, FGFR2, FGFR3, FGFR4, VEGFR1, VEGFR2, VEGFR3, Trk-A, Trk-B, Trk-C, and insulin receptor transmembrane domain.

Embodiment P-77. The recombinant protein of any one of Embodiments 74-76, wherein the Type I transmembrane domain is an EGFR transmembrane domain.

Embodiment P-78. The recombinant protein of any one of Embodiments 74-77, wherein the IgG antibody is an IgG1 antibody, an IgG2 antibody, an IgG3 antibody, or an IgG4 antibody.

Embodiment P-79. The recombinant protein of any one of Embodiments 74-78, wherein the IgG domain is an IgG1 antibody.

Embodiment P-80. The recombinant protein of any one of Embodiments 74-78, wherein the IgG domain is an IgG2 antibody.

Embodiment P-81. The recombinant protein of any one of Embodiments 74-78, wherein the IgG domain is an IgG3 antibody.

Embodiment P-82. The recombinant protein of any one of Embodiments 74-78, wherein the IgG domain is an IgG4 antibody.

Embodiment P-83. The recombinant protein of any one of Embodiments 74-82, wherein the Fc region comprises one or more amino acids conferring high binding affinity for one or more of CD32 (FcγRII), CD16 (FcγRIII), and CD64 (FcγRI) compared to wild type Fc.

Embodiment P-84. The recombinant protein of any one of Embodiments 74-83, wherein the Fc region has a dissociation constant of about $1 \times 10^{-5}$ M to about $1 \times 10^{-13}$ M to CD32.

Embodiment P-85. The recombinant protein of any one of Embodiments 74-83, wherein the Fc region has a dissociation constant of about $1 \times 10^{-5}$ M to about $1 \times 10^{-13}$ M to CD16.

Embodiment P-86. The recombinant protein of any one of Embodiments 74-83, wherein the Fc region has a dissociation constant of about $1 \times 10^{-5}$ M to about $1 \times 10^{-13}$ M to CD64.

Embodiment P-87. The recombinant protein of any one of Embodiments 74-85, wherein the recombinant protein is resistant to protease cleavage.

Embodiment P-88. The recombinant protein of Embodiment 87, wherein the protease is an IgG specific protease.

Embodiment P-89. The recombinant protein of Embodiment 88, wherein the IgG protease is IdeS.

Embodiment P-90. The recombinant protein of Embodiment 88, wherein the IgG protease is IdeZ.

Embodiment P-91. The recombinant protein of Embodiment 87, wherein the protease is selected from pepsin, matrix metalloproteinase 7 (MMP7), matrix metalloproteinase 3 (MMP3), matrix metalloproteinase (MMP12), cathepsin G, and glutamyl endopeptidase V8 (GluV8).

Embodiment P-92. The recombinant protein of any one of Embodiments 74-91, wherein the recombinant protein comprises a hinge region and wherein the hinge region comprises a protease resistant sequence at amino acid positions 246-252 according to the EU numbering of Kabat and that is 2 or more amino acids in length.

Embodiment P-93. The recombinant protein of Embodiment 92, wherein the protease resistant sequence is 3 amino acids in length.

Embodiment P-94. The recombinant protein of Embodiment 92, wherein the protease resistant sequence is 4 amino acids in length.

Embodiment P-95. The recombinant protein of Embodiment 92, wherein the protease resistant sequence is 5 amino acids in length.

Embodiment P-96. The recombinant protein of Embodiment 92, wherein the protease resistant sequence is 6 amino acids in length.

Embodiment P-97. The recombinant protein of Embodiment 92, wherein the protease resistant sequence is 7 amino acids in length.

Embodiment P-98. The recombinant protein of Embodiment 92, wherein the hinge region comprises the amino acids of SEQ ID NO: 545.

Embodiment P-99. An isolated nucleic acid encoding the recombinant protein of any one of Embodiments 46-98.

Embodiment P-100. An expression vector comprising the nucleic acid of Embodiment 99.

Embodiment P-101. A cell comprising the expression vector of Embodiment 100.

Embodiment P-102. The cell of Embodiment 101, wherein the cell is a eukaryotic cell.

Embodiment P-103. The cell of Embodiment 101 or 102, wherein the cell is a Chinese hamster ovary cell.

Embodiment P-104. The cell of any one of Embodiments 101-103, wherein an IgG antibody is expressed at the surface of the cell.

Embodiment P-105. An anti-CD20 antibody comprising the CDRs as set forth in FIG. 3.

Embodiment P-106. A method of binding a ligand to a CHO cell surface recombinant protein, the method comprising contacting a ligand with a CHO cell surface recombinant protein, wherein said CHO cell surface recombinant protein comprises:

i. an EGFR-transmembrane domain; and ii. an immunoglobulin G (IgG) antibody;

wherein the EGFR-transmembrane domain is fused to the C-terminus of the IgG domain; and wherein the IgG antibody is capable of binding a ligand; and wherein the CHO cell surface protein is resistant to cleavage by an IgG-specific protease or has higher binding affinity for one or more of CD32 (FcγRII), CD16 (FcγRIII), and CD64 (FcγRI).

Embodiment P-107. A method of treating cancer in a patient comprising administering a therapeutic IgG antibody and an IgG specific protease, wherein the therapeutic IgG antibody is resistant to an IgG specific protease.

Embodiment P-108. The method of Embodiment 107, wherein the therapeutic IgG antibody has a dissociation constant of about $1 \times 10^{-5}$ M to about $1 \times 10^{-13}$ M to one or more of CD20, CD32 (FcγRII), CD16 (FcγRIII), and CD64 (FcγRI).

Embodiment P-109. A method of enhancing efficacy of therapeutic IgG antibody in a subject comprising administering to the subject an IgG specific protease and a therapeutic IgG that is resistant to the IgG specific protease.

Embodiment P-110. The method of Embodiment 109, wherein the IgG specific protease is selected from IdeS and IdeZ

EXAMPLES

Example 1: IgG Antibodies and Endopeptidase

FIG. 1 schematically illustrates that human immune cells are naturally coated with endogenous IgG, which prevents interactions between a therapeutic mAb and FcγRs expressed on the surface of the human immune cells. This thereby limits the binding of therapeutic mAb to FcγRs thus limits the efficacy of the therapeutic mAb.

Figure 2:
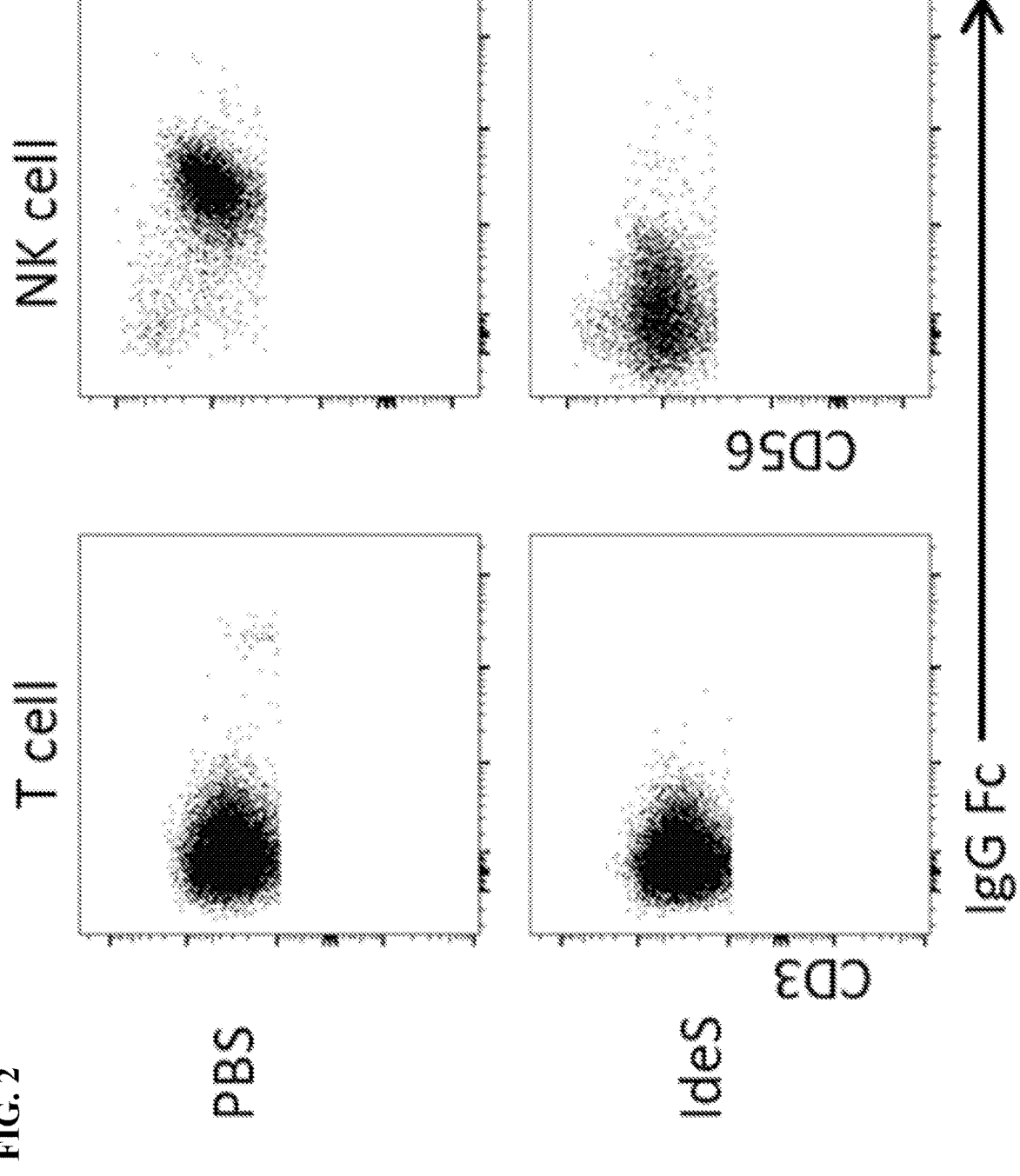
FIG. 2 provides flow cytometric data demonstrating that human NK cells are naturally coated with IgG molecules, which can be removed by incubation with the IdeS enzyme. Human peripheral blood mononuclear cells (PBMCs) were digested with IdeS for 30 minutes at 37° C. and stained with antibodies against linage markers or against human IgG Fc. Note CD3+ T cells do not express FcγRs and therefore do not bind human IgG under any condition.
Figure 4A:
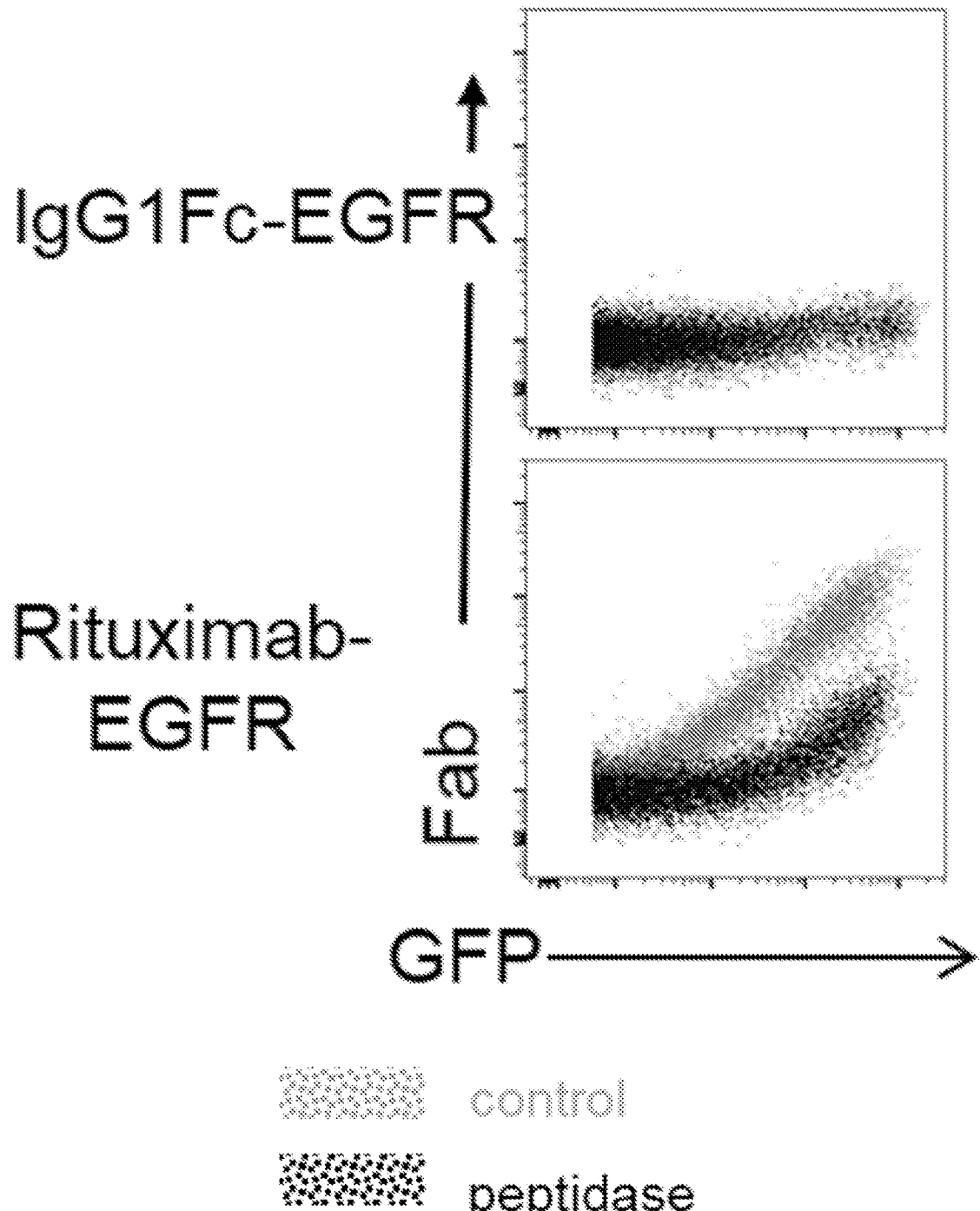
FIGS. 4A-4E illustrate flow cytometry density plots of display of various functional IgG proteins on GFP+ Chinese hamster ovary (CHO) cells in the absence or presence of IgG specific protease (IdeS or IdeZ peptidase). The gray dots represent CHO cells treated with control, and black dots represent CHO cells treated with IdeS or IdeZ peptidase, the IgG specific proteases that cleave the IgG hinge region preventing the IgG molecule from binding to Fc-gamma receptors.
Figure 4B:
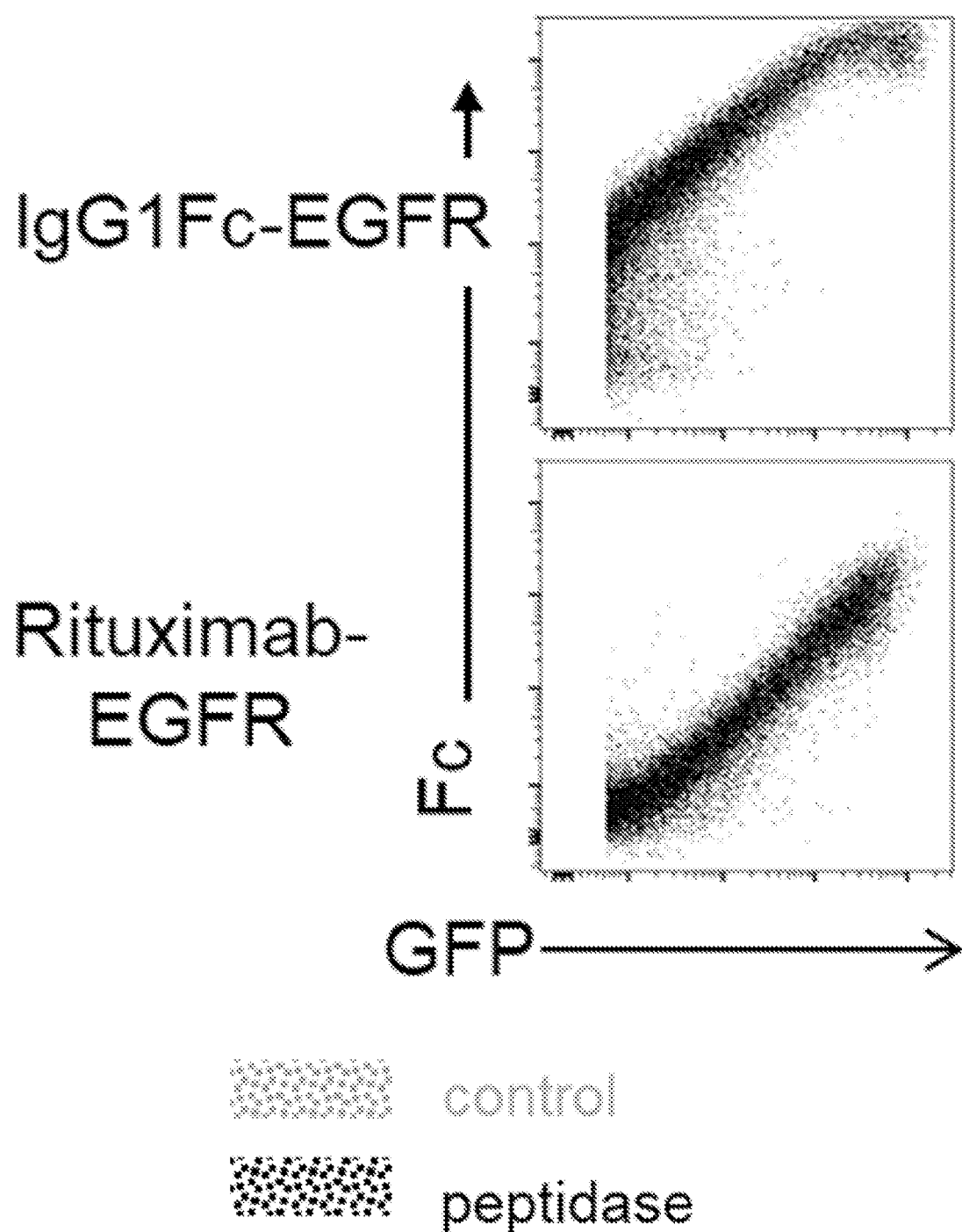
Figure 4C:
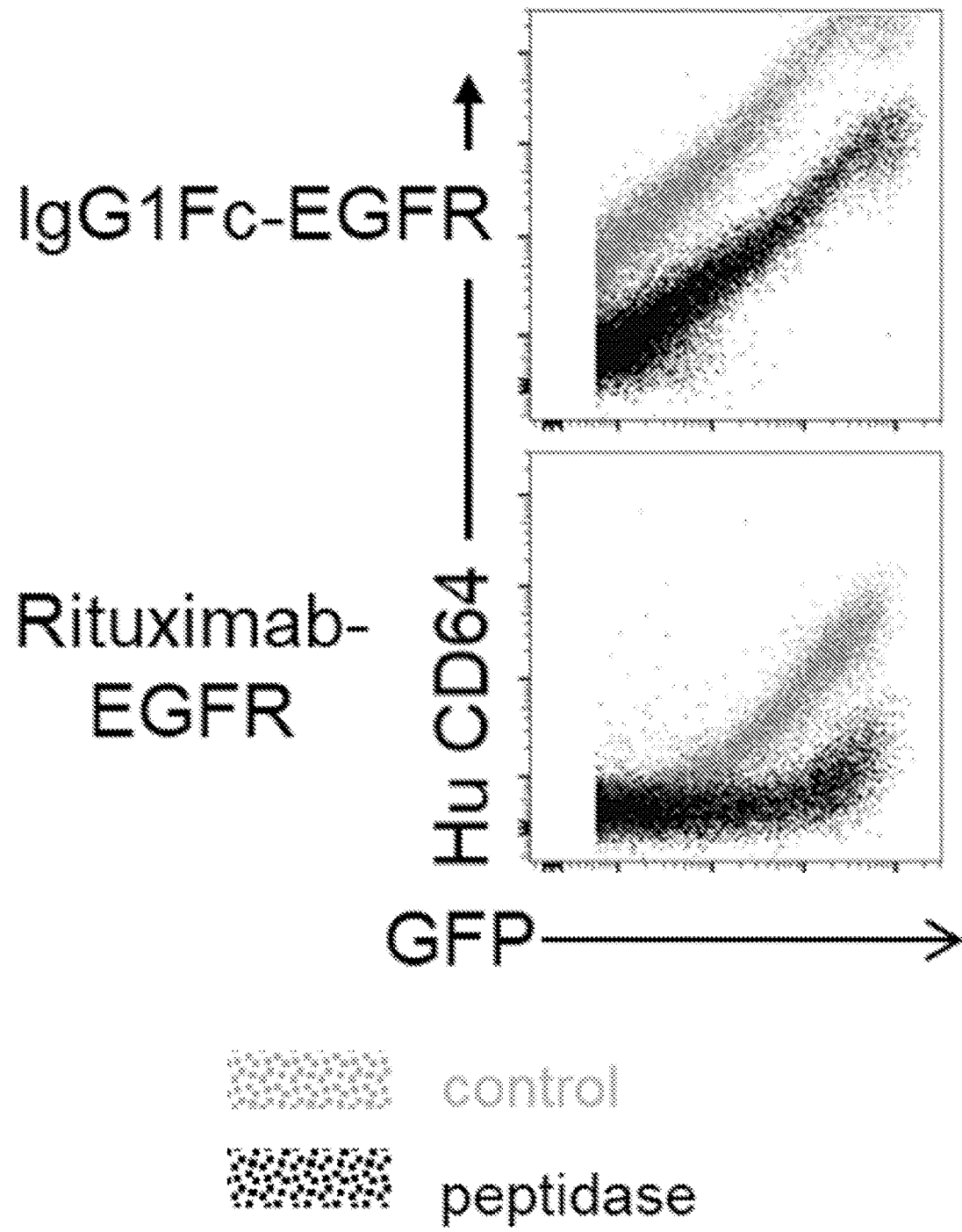
Figure 4D:
Figure 4E:
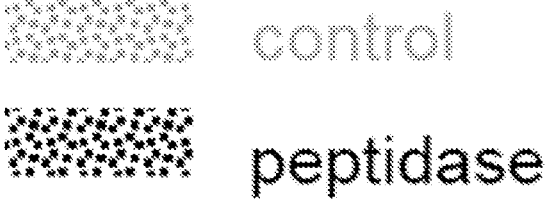

The flow cytometric data in FIG. 2 demonstrates that human NK cells are naturally coated with IgG molecules, which can be removed by incubation with the IdeS enzyme. Human PBMCs were digested with IdeS for 30 minutes at 37° C. and stained with antibodies against linage markers or against human IgG Fc. Note CD3+ T cells do not express FcγRs and therefore do not bind human IgG under any condition.

FIG. 3 schematically illustrates a strategy for enhancing therapeutic efficiency of mAbs. Panel (a) depicts FcγRs on immune cells are normally occupied by endogenous IgG; panel (b) shows IdeS digestion can remove endogenous IgG and free-up FcγR binding sites for infused therapeutic mAbs, which are engineered to be resistant to IdeS and retain FcγR binding function; (c) shows infused therapeutic mAb may first bind onto unoccupied FcγR or as depicted in (d) may first bind tumor-associated antigen expressed on the cancer cell. Regardless, once the antigen-mAb-FcγR crosslink, the FcγR+ cell undergoes immune activation (f). The flow chart illustrates that the more FcγRs that are unoccupied and therefore available for binding the therapeutic mAb, the more tumor cells are eliminated.

Example 2: Novel Therapeutic Antibody Screening and Engineering Platform

A number of FDA approved antibody therapeutics developed thus far are produced in Chinese hamster ovarian (CHO) cells, because recombinant proteins produced by CHO cells possess post translational modifications that are compatible and bioactive in humans. Therefore, CHO cells represent an ideal system for therapeutic antibody screening and engineering.

The experiments conducted herein aimed to develop a method to display full length, fragments, or combinations of Ig- and/or Fc-containing fusion proteins on the surface of CHO cells.

A method of selecting one subset of CHO cell surface expressed EGFR-TMH/mAb and EGFR-TMF/FcγR fusion proteins via flow cytometry was developed. Each IgG or Fc-containing molecule expressed on the surface of the CHO cells is fully functional, including individual IgG domains, Fc domains, partial antibodies, partial receptors, full length antibody, full length antibody, or a combination of individual IgG/Fc domains behaves similarly to the analogous soluble construct (removing the EGFR-TMH portion). Flow cytometry was employed as the method to study different portions of these molecules, identifying their physical and chemical characteristics for an application of interest.

EGFR TMH (SEQ ID NO: 6) was tested to optimize surface expression of IgG in CHO cells. As shown in the top row of FIG. 4, results for surface expression of IgG-Fc with a GFP reporter are presented. In the bottom row of FIG. 4, results for surface expression of full length rituximab with a GFP marker are presented. The fluorescence of GFP on the X axis is proportional to the surface density expression of Fc and of rituximab on the surface of the CHO cells. Each of these two IgG molecules expressed on the surface of the CHO cells was as functional as soluble IgG, allowing use of flow cytometry to study different portions of the IgG. This eliminates the need for protein purification to optimize mAb binding properties to their cognate antigen and to the three classes of Fc-gamma receptors (FcγR) expressed on the surface of innate immune effector cells.

The hinge region of IgG is almost untouched by previous studies because it is highly flexible and the two hinges bind FcγR tightly and asymmetrically. IgG1 FcΔ16 was made by deleting the WT hinge region sequence ELLGGPS (SEQ ID NO: 544). Amino acids were added to the N-terminus of IgG1 FcΔ16 and variants that gained CD16α binding were selected for next round modification. Several de novo hinge regions were generated using the CHO cell display platform which shows higher affinity to FcγRs than the original (or wild type) hinge region. It is important to note that this technology is also a platform technology in that it can be used to modify any antibody for which the sequence is known in order to obtain variants with increased or decreased binding affinity for FcγRs.

FIG. 5 illustrates the generation of new lower hinge for IgG1Fc with enhanced binding affinity to CD16α and resistance to cleavage by IdeS and IdeZ. Amino acids were added in a stepwise fashion to the N-terminus of IgG1 Δ16 (SEQ ID NO: 16), which does not bind CD16α. Clones acquiring CD16α binding were selected for by sequentially attaching more amino acids step by step to increase binding affinity. The 7AA de novo hinge regions that were tested, found to be resistant to IdeS/Z and showed similar or higher binding affinity to CD16x than the wild type sequence were engrafted to the mAb.

The wild type lower hinge region of human IgG1 binds to FcγRIII CD16α with relatively low affinity (FIG. 6). Panel (A) shows human IgG1 Fc 416 (SEQ ID NO: 16), which lacks of the wild type hinge (ELLGGPS; SEQ ID NO: 544), lost binding to FcγRIII CD16. Four-hundred (400) combinations of 2 amino acids were added to the N-terminus of human IgG1 Fc Δ16, and individually measured for their binding to CD16α and other FcγRs. Among all the sequences that acquired CD16a binding, DW was selected for next round optimizations which lead to the identification of CWDW (SEQ ID NO:648), and subsequently other 6 and 7 AA sequences.

Figures 6A, 6B:
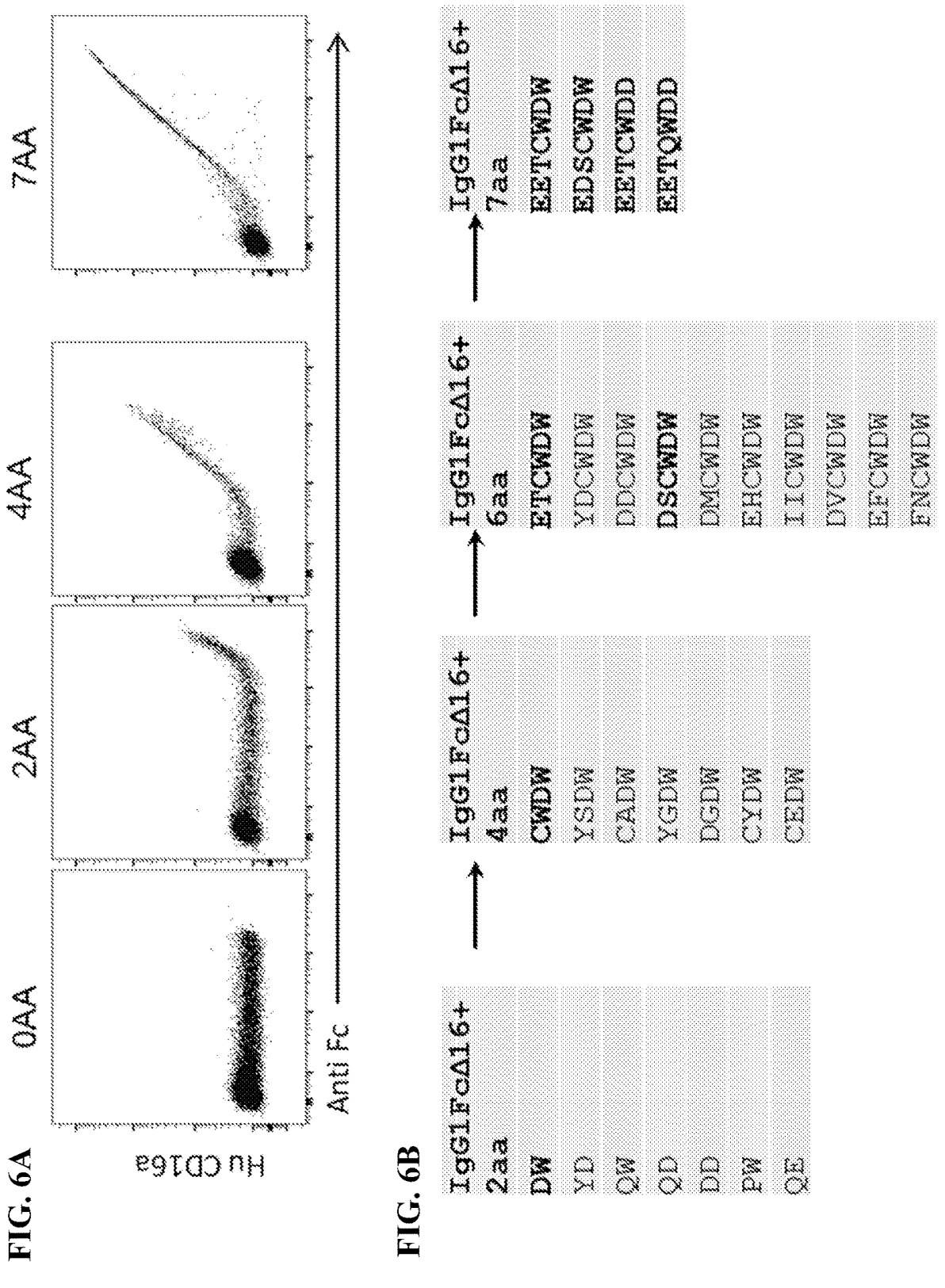
FIGS. 6A-B illustrate the stepwise acquisition of CD16α binding by sequentially adding amino acids (AAs) to IgG1FcΔ16 at its N-terminus.

FIG. 6 illustrates the stepwise acquisition of CD16α binding by sequentially adding AAs to IgG1FcΔ16 at its N-terminus. FIG. 6A show binding affinity of various constructs of human IgG1FcΔ16 fused with EGFR transmembrane helix domain and displayed as a type 1 membrane protein on the CHO cell surface. Due to the lack of a hinge region, IgG1FcΔ16 does not bind human CD16α. Four hundred 2AA combinations were added at the N-terminus of IgG1FcΔ16 and individually assayed for their binding to CD16α by rapid flow cytometric analysis. The first two AA, DW, were selected for further optimization and led to the identification of 4AA, 6AA and 7AA de novo hinges with increasing CD16α binding as shown. These experiments were performed in the presence of IdeS, demonstrating resistance of the novel IgG1 hinge regions to cleavage. FIG. 6B shows individual panels of all the positive clones as more AAs were added.

Figure 7:
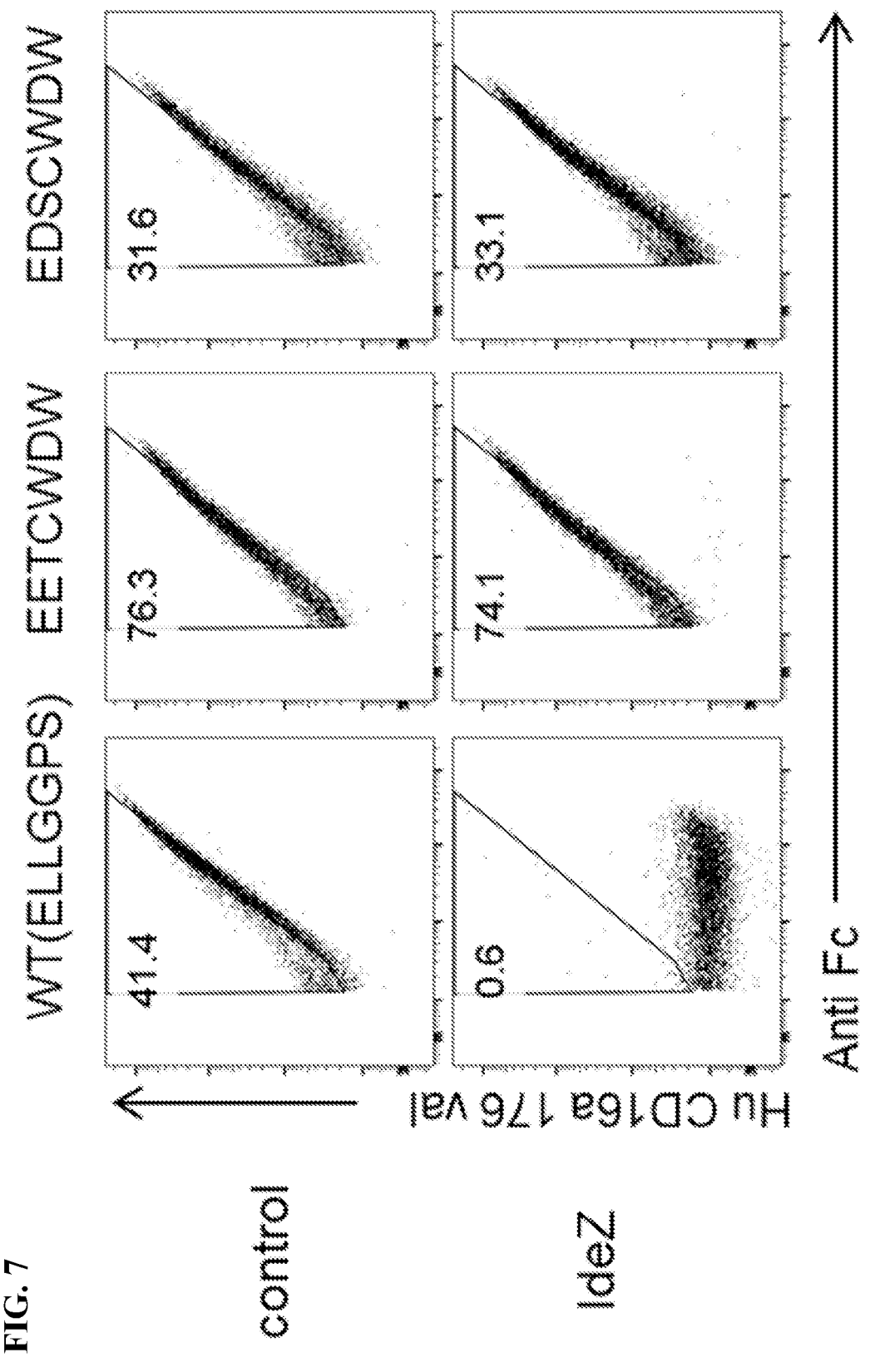
FIG. 7 shows data collected from CHO cells transfected with rituximab-EGFR. The hinge region of the rituximab is composed of either the wild type (WT) hinge (ELLGGPS; SEQ ID NO: 544), or one of two de novo IdeS/IdeZ-resistant hinges: EETCWDW (SEQ ID NO:545), which has higher affinity for FcγR CD16α than the WT or EDSCWDW (SEQ ID NO:546), which has lower affinity for FcγR CD16α than the WT.

FIG. 7 shows data collected from CHO cells transfected with rituximab-EGFR. The hinge region of the rituximab is composed of either the wild type (WT) hinge (ELLGGPS; SEQ ID NO: 544), or one of two de novo IdeS/IdeZ-resistant hinges: EETCWDW (SEQ ID NO:545), which has higher affinity for FcγR CD16α than the WT or EDSCWDW (SEQ ID NO:546), which has lower affinity for FcγR CD16α than the WT. The assessment of surface IgG1 expression on the CHO cells was accomplished using soluble fluorescent labeled CD16α Val176 binding and fluorescent labeled anti-human Fc antibody (that binds a region of the Fc not affected by the cleavage). CD16α Val176 and Phel76 are polymorphisms with different affinity for IgG1. Transfected CHO cells were either incubated with media alone (control, upper row) or digested with IdeZ at 37° C. for 30 minutes before staining (lower row). The binding affinities of IgG1 for CD16α are indicated in the upper left-hand quadrant of each histogram. As noted in the lower row, incubation with IdeZ resulted in cleavage of the WT hinge with loss of CD16α binding and affinity), while the de novo hinges were resistant to cleavage by IdeZ and therefore retained both binding and nearly identical affinity when compared to the upper row.

Figure 8:
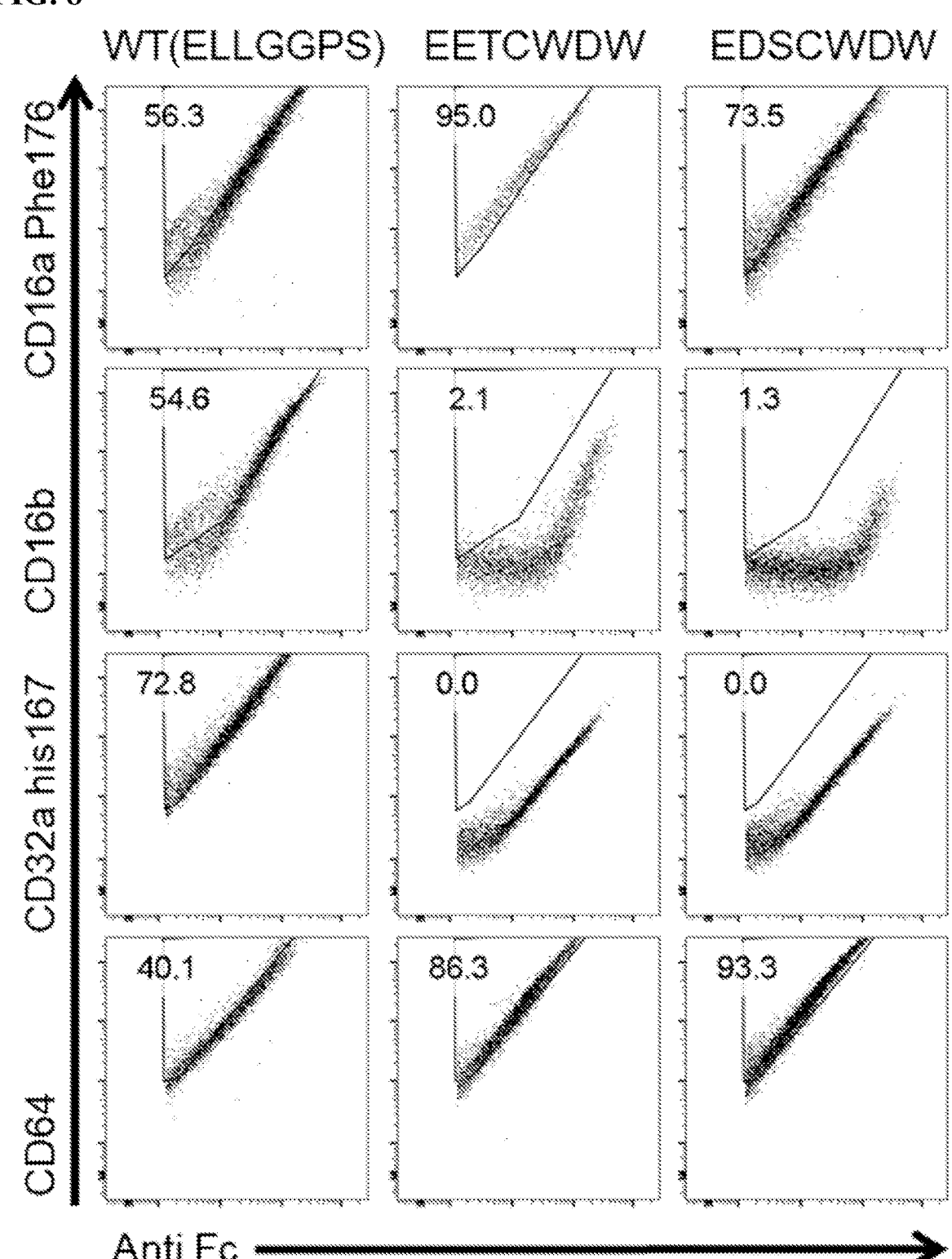
FIG. 8 shows binding affinity of various FcγRs to CHO cells expressing rituximab whose hinge moiety is either WT (ELLGGPS; SEQ ID NO: 544) or has been engineered with novel de novo hinge regions variants (EETCWDW, SEQ ID NO: 545; or EDSCWDW. SEQ ID NO: 546) using the methodology described herein and shown in FIG. 7. The resulting surface IgG expression and binding affinities of various FcγRs were quantified using fluorescent labeled FcγRs ectodomain as indicated on the Y axis, and fluorescent labeled anti-human Fc antibody on the X axis. The FcγRs binding affinity to each hinge moiety is indicated in the upper left quadrant of each histogram.
Figure 10:
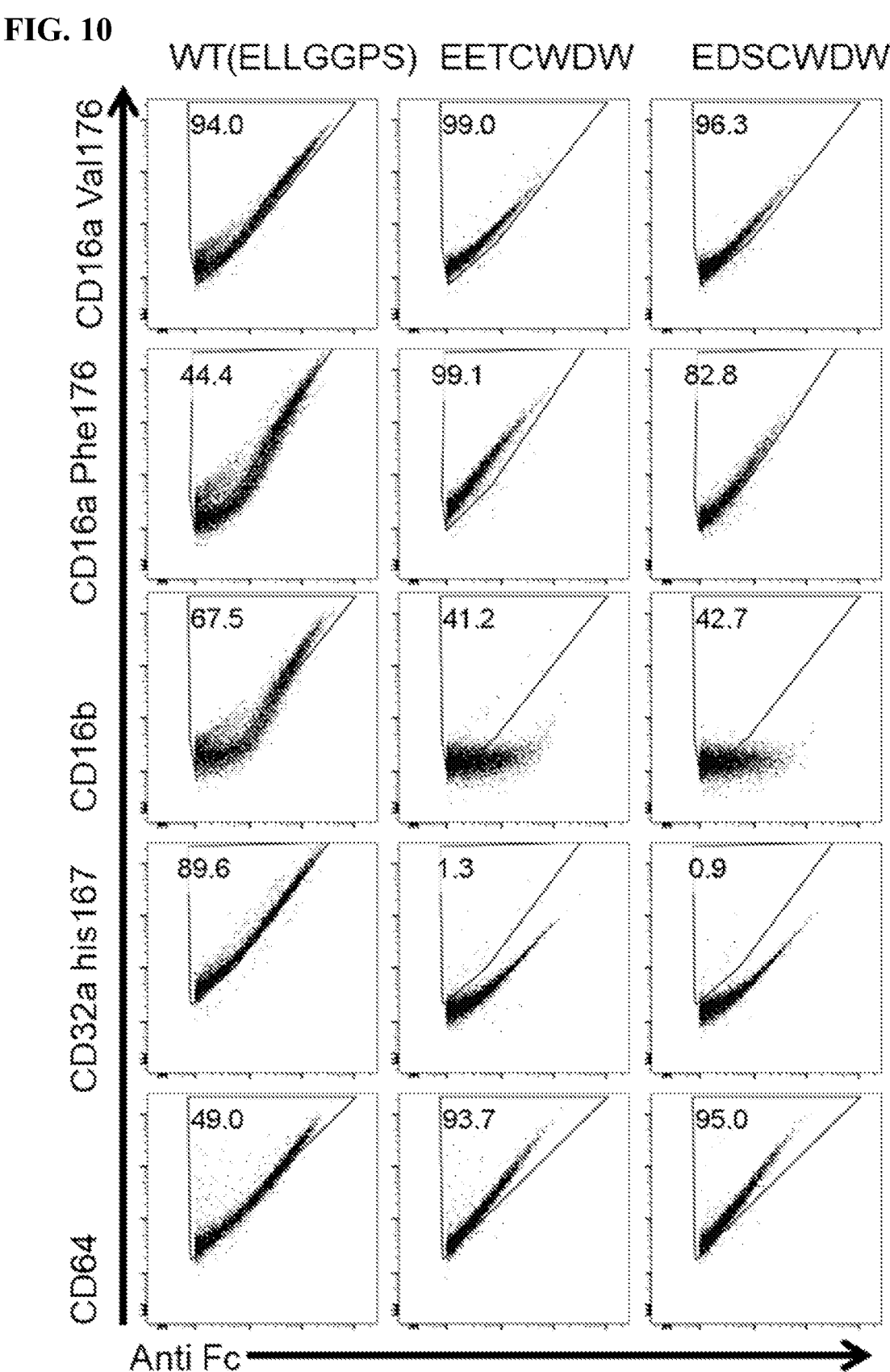
FIG. 10 shows CHO cells transfected with trastuzumab-EGFR. The trastuzumab contains either its wild type (WT) (SEQ ID NO:544) hinge moiety or one of two de novo novel hinge moieties EETCWDW (SEQ ID NO:545) or EDSCWDW (SEQ ID NO:546) that were engineered to replace of the WT hinge region of trastuzumab using the same methodology described herein for rituximab. The resulting surface IgG expression and binding affinities of various FcγRs were quantified using fluorescent labeled FcγRs ectodomain as indicated on the Y axis, and fluorescent labeled anti-human Fc antibody on the X axis. The FcγRs binding affinity to each hinge moiety is indicated in the upper left quadrant of each histogram.

De novo hinges can be engrafted into different antibodies and still retain the same IdeS/IdeZ resistance and improved FcγRs binding (FIG. 8, FIG. 10). Similar constructs can be generated to modify mAb binding to the three classes of IgG FcγRs. It is well established that there are three classes of FcγR: FcγRI (CD64) has the highest affinity and is found on granulocytes; FcγRII (CD32) has intermediate affinity and is found on monocytes and dendritic cells; FcγRIII (CD16) has lower affinity and is found on monocytes, macrophages and on natural killer cells. IgG contains two Fab arms, an Fc domain and a flexible hinge region linked between the Fab arms and the Fc domain. Both the Fc domain and the hinge region of IgG contribute to binding FcγRs (including CD64, CD32, CD16) expressed on innate immune effector cells and mediate target cell destruction by cellular means including antibody-dependent cellular cytotoxicity (ADCC) and/or antibody-dependent cellular phagocytosis (ADCP). Significant efforts have been made toward improving IgG-FcγR binding.

FIG. 8 shows binding affinity of various FcγRs to CHO cells expressing rituximab whose hinge moiety is either WT (ELLGGPS; SEQ ID NO: 544) or has been engineered with novel de novo hinge regions variants (EETCWDW, SEQ ID NO: 545 or EDSCWDW, SEQ ID NO: 546) using the methodology described herein and shown in FIG. 7. The resulting surface IgG expression and binding affinities of various FcγRs were quantified using fluorescent labeled FcγRs ectodomain as indicated on the Y axis, and fluorescent labeled anti-human Fc antibody on the X axis. The FcγRs binding affinity to each hinge moiety is indicated in the upper left quadrant of each histogram. Note that the two novel AA hinge regions (EETCWDW, SEQ ID NO: 545 and EDSCWDW, SEQ ID NO: 546) show a dramatic decrease in affinity to CD16b and CD32a compared to WT (ELLGGPS, SEQ ID NO: 544), but show higher affinity to CD16α and CD64 compared to WT.

Figure 9:
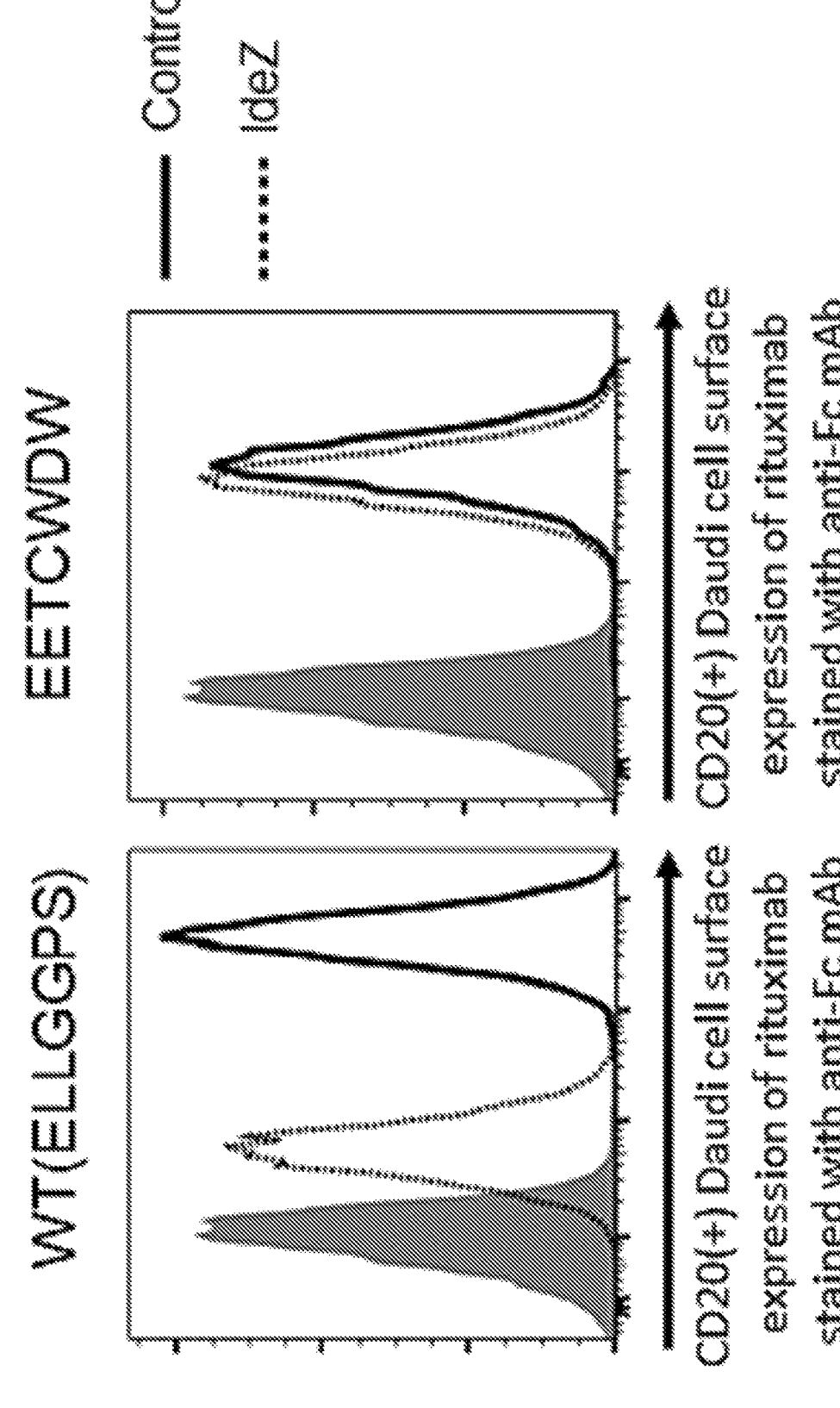
FIG. 9 provides a representative example illustrating the resistance of the novel hinge region (EETCWDW (SEQ ID NO:545)) to cleavage by IdeS/IdeZ. The WT rituximab pre-incubated with IdeZ can no longer be detected on the surface of the CD20 (+) Daudi lymphoma cells when stained with fluorescently-labelled anti human Fc antibody (left histogram, dashed line), while the EETCWDW (SEQ ID NO:545) rituximab can still be detected (right histogram, dashed line).

FIG. 9 provides a representative example illustrating the resistance of the novel hinge region (EETCWDW (SEQ ID NO:545)) to cleavage by IdeS/IdeZ. In this example the anti-CD20 mAb rituximab either contains its wild type (WT) hinge region or has been engineered to express the novel (EETCWDW (SEQ ID NO:545)) hinge region. WT rituximab or EETCWDW (SEQ ID NO: 545) rituximab were first incubated at 37° C. for 30 minutes in the presence or absence of IdeZ protease. Next, the CD20(+) Daudi lymphoma cells were incubated with the processed WT or novel (EETCWDW (SEQ ID NO:545)) rituximab, washed and then stained with fluorescently-labelled anti human Fc antibody. The WT rituximab pre-incubated with IdeZ can no longer be detected on the surface of the CD20(+) Daudi lymphoma cells when stained with fluorescently-labelled anti human Fc antibody (left histogram, dashed line), while the EETCWDW (SEQ ID NO: 545) rituximab can still be detected (right histogram, dashed line).

Example 3: Endopeptidase Resistant Hinge and FcγR Binding

The selection of the EETCWDW (SEQ ID NO:545) hinge region and its variants for FcγR binding properties and resistance to IdeS/IdeZ represents a platform technology, because the results seen with the anti-CD20 mAb rituximab are highly reproducible using a second unrelated therapeutic mAb, the anti-Her2/neu mAb called trastuzumab or Herceptin®. FIG. 10 shows CHO cells transfected with trastuzumab-EGFR. The trastuzumab contains either its wild type (WT) hinge moiety or one of two de novo novel hinge moieties EETCWDW (SEQ ID NO: 545) or EDSCWDW (SEQ ID NO: 546) that were engineered to replace of the WT hinge region of trastuzumab using the same methodology described herein for rituximab. EETCWDW (SEQ ID NO: 545) and EDSCWDW (SEQ ID NO:546) trastuzumab demonstrate identical binding properties as was demonstrated with rituximab when engineered with the same two novel hinge regions as shown in FIG. 8. Specifically, the two novel trastuzumab mAbs with AA hinge regions (EETCWDW (SEQ ID NO:545) or EDSCWDW (SEQ ID NO:546)) show a dramatic decrease in affinity to CD16β and CD32α compared to WT (ELLGGPS (SEQ ID NO: 544)) but show higher affinity to CD16α and CD64 than WT yet show no cleavage by either IdeZ or IdeS (not shown). The resulting surface IgG expression and binding affinities of various FcγRs were quantified using fluorescent labeled FcγRs ectodomain as indicated on the Y axis, and fluorescent labeled anti-human Fc antibody on the X axis. The FcγRs binding affinity to each hinge moiety is indicated in the upper left quadrant of each histogram.

Figure 11A:
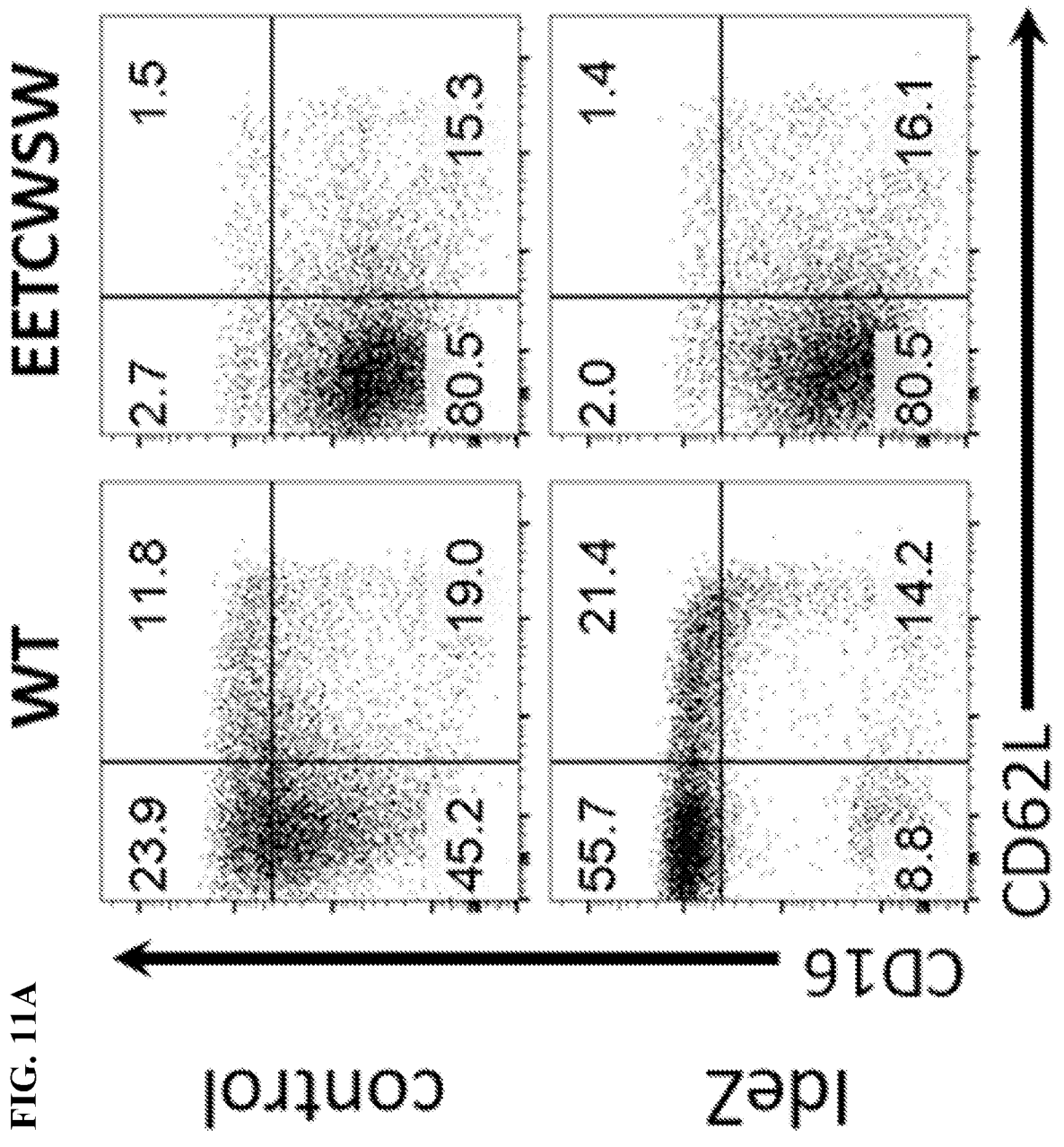
FIGS. 11A-C demonstrate activity of a rituximab variant.
Figure 11B:
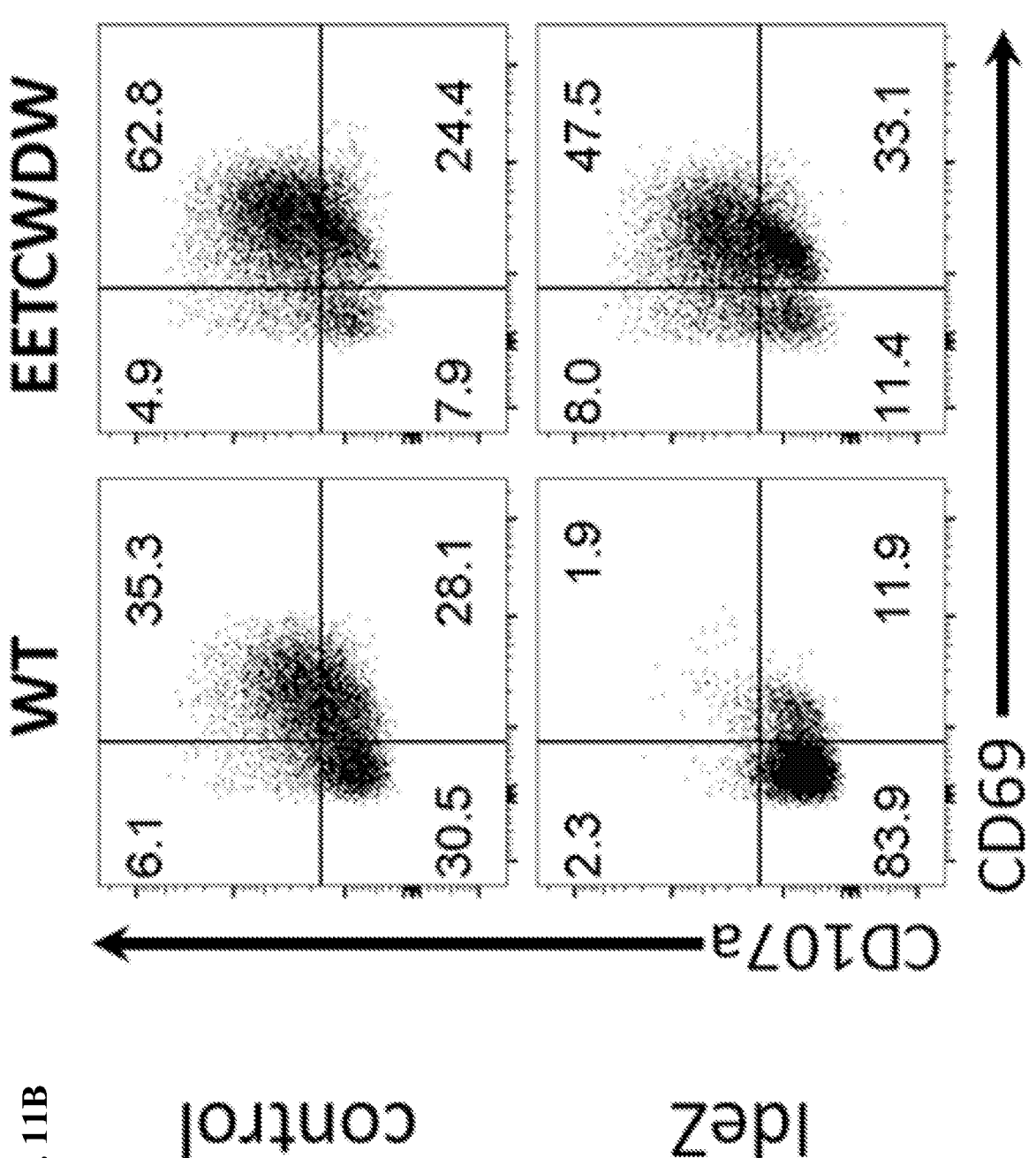

FIG. 11 shows natural killer (NK) cell activation by staining for CD16/CD62L and CD107α/CD69, respectively. The higher affinity of EETCWDW (SEQ ID NO:545) rituximab for CD16α (compared to WT rituximab) leads to greater or stronger activation of the NK cell. When the NK cells' CD16 recognizes and binds EETCWDW (SEQ ID NO:545) rituximab that is bound to the B cell target, there is greater downregulation of CD16α, compared to the NK cells CD16 recognizing WT rituximab bound to the B cell target (compare FIG. 11A upper "control" row left lower quadrant "WT" (45.2) vs "EETCWDW" (80.5) (SEQ ID NO:545). The same is true for CD62L which downregulated following NK cell activation. When the NK cell recognizes EETCWDW (SEQ ID NO:545) rituximab binding to the B cell target, there is greater upregulation of CD107a, compared to the NK cell recognizing WT rituximab binding to the B cell target (compare FIG. 11B upper "control" row right upper quadrant "WT" (35.3) vs "EETCWDW" (62.8) (SEQ ID NO:545). The same is true for CD69. Further, treatment with IdeZ virtually eliminates activation of NK cells by WT rituximab (compare FIG. 11A "control" row, left lower quadrant "WT" (45.2) vs lower "IdeZ" row, left lower quadrant "WT" (8.8); and compare (FIG. 11B) upper "control" row right upper quadrant "WT" (35.8) vs lower "IdeZ" row, right upper quadrant "WT" (1.9). In contrast, treatment with IdeZ results in no or little decrease in NK cell activation by EETCWDW (SEQ ID NO:545) rituximab (compare FIG. 11A "control" row, left lower quadrant "EETCWDW" (80.5) (SEQ ID NO:545) vs lower "IdeZ" row, left lower quadrant "EETCWDW" (80.5) (SEQ ID NO:545); and compare FIG. 11B upper "control" row right upper quadrant "EETCWDW" (62.8) (SEQ ID NO:545) vs lower "IdeZ" row, right upper quadrant "EETCWDW" (47.5) (SEQ ID NO:545).

Figure 11C:
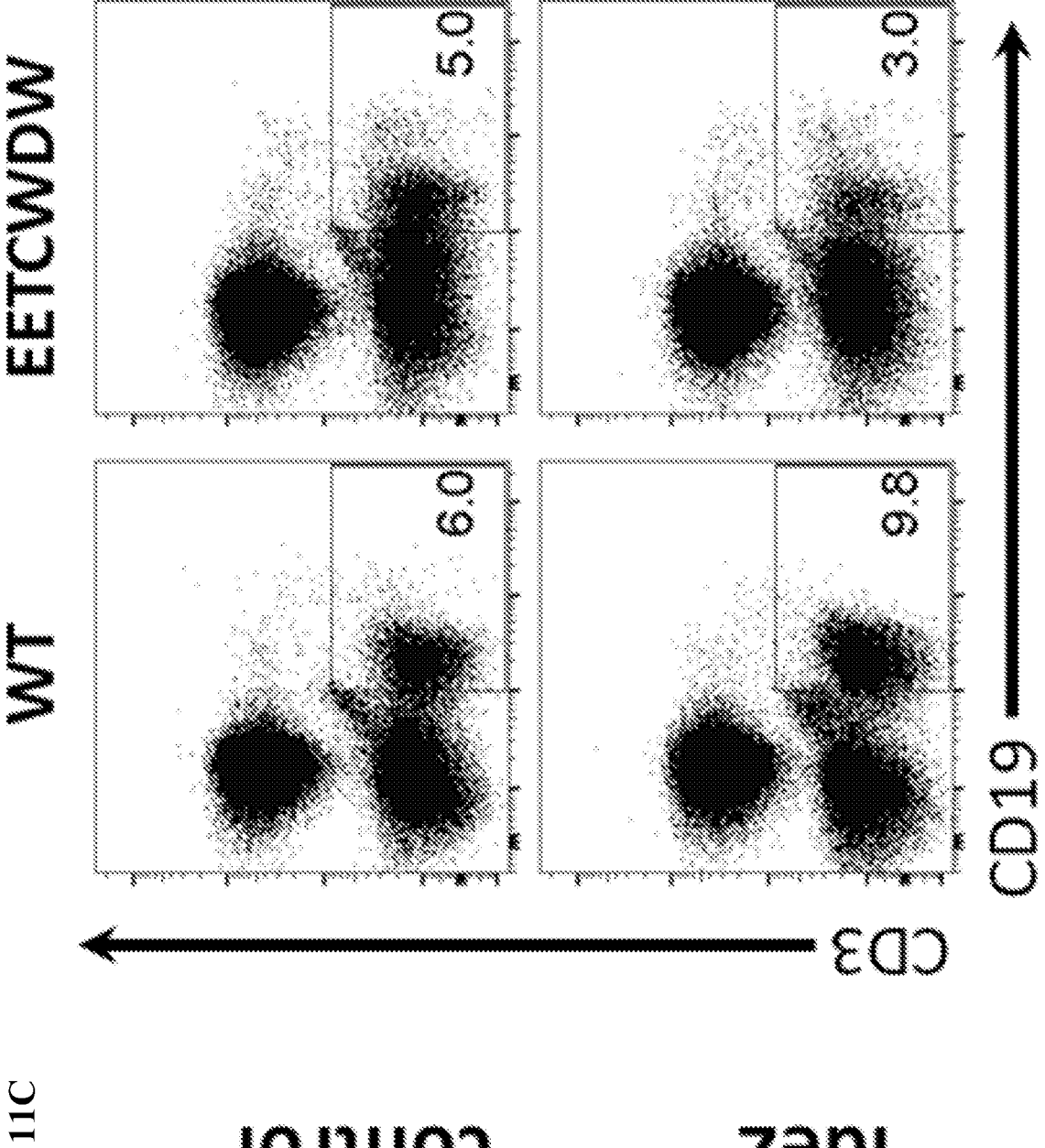

FIG. 11C shows representative data demonstrating that the higher affinity of EETCWDW (SEQ ID NO:545) rituximab for CD16α leads to greater NK cell depletion of B cells in blood by antibody dependent cellular cytotoxicity (ADCC), and even greater depletion in the presence of IdeZ ("IdeZ"), when compared to WT rituximab. When the NK cell recognizes EETCWDW (SEQ ID NO:545) rituximab binding to the CD19(+) B cell target in blood without IdeZ ("control"), there is 17% greater depletion of CD19(+) B cells compared to the NK cell recognizing WT rituximab binding to the CD19(+) B cell target in control blood (compare FIG. 11C upper "control" row right lower quadrant "WT" (6.0) vs "EETCWDW" (5.0) (SEQ ID NO: 545). However, when the NK cell recognizing WT rituximab binding to the CD19(+) B cell target in control blood is compared to the NK cell recognizing WT rituximab binding to the CD19(+) B cell target following incubation with IdeZ, CD19(+) B cell depletion is 63% worse (compare FIG. 11C upper "control" row right lower quadrant "WT" (6.0) vs lower "IdeZ" row right lower quadrant "WT" (9.8). In contrast, when to the NK cell recognizes EETCWDW (SEQ ID NO:545) rituximab binding to the CD19(+) B cell target following incubation with IdeZ, CD19(+) B cell depletion is improved by 50% when compared to NK cells recognizing WT rituximab binding to the CD19(+) B cell target following incubation with control blood (compare FIG. 11C upper "control" row right lower quadrant "WT" (6.0) vs lower "IdeZ" row right lower quadrant "EETCWDW" (3.0) (SEQ ID NO:545).

In FIG. 11A, it was demonstrated that the higher affinity of EETCWDW (SEQ ID NO:545) rituximab for CD16α

Figure 12:
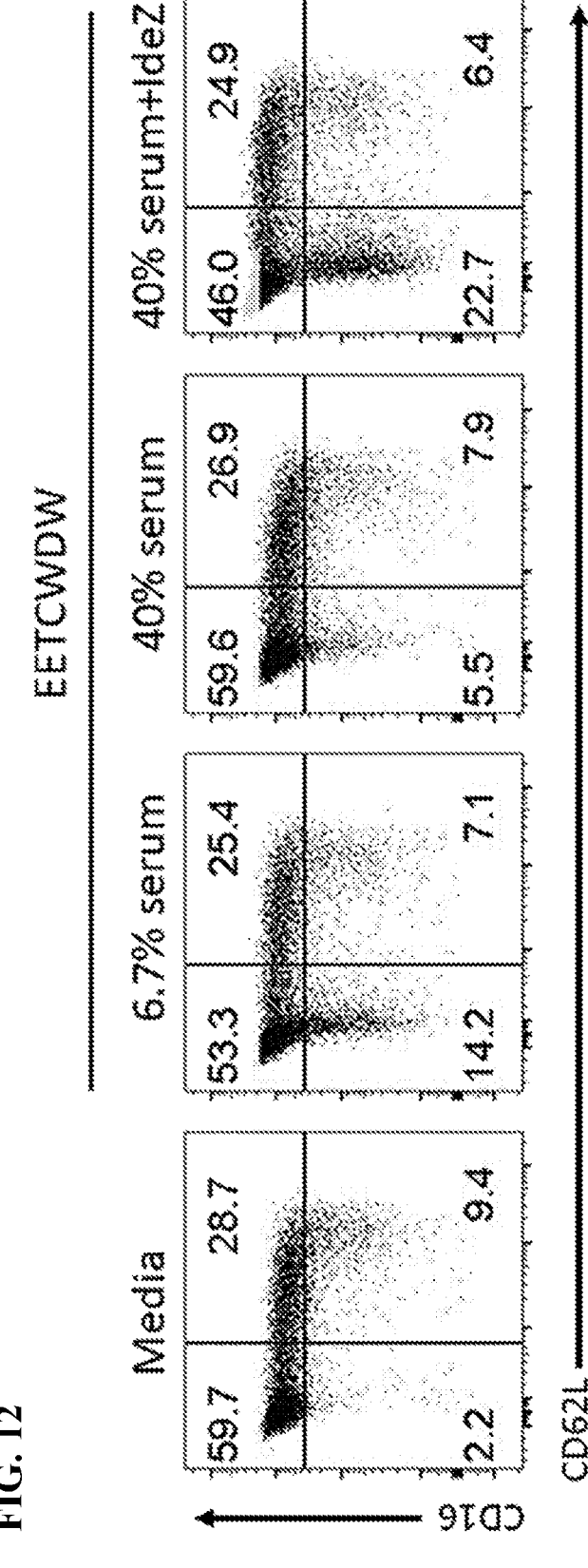
FIG. 12 demonstrates how increasing concentrations of AB serum (and therefore increasing the concentration of endogenous IgG) in blood out competes EETCWDW (SEQ ID NO: 545) rituximab for binding to NK cell FcγRIIIA (CD16α), thereby diminishing NK cell activation.

(compared to WT rituximab) leads to greater or stronger activation of the NK cell in whole blood, as measured by the downregulation of CD16α. FIG. 12 demonstrates how increasing concentrations of AB serum (and therefore increasing the concentration of endogenous IgG) in blood out competes EETCWDW (SEQ ID NO:545) rituximab for binding to NK cell FcγRIIIA (CD16α), thereby diminishing NK cell activation (compare the ability of NK cells' CD16 to recognize and bind EETCWDW (SEQ ID NO:545) rituximab bound to B cells in blood containing 6.7% serum (14.2% of NK cells down regulate surface expression of CD16) versus the ability of NK cells' CD16 to recognize and bind EETCWDW (SEQ ID NO:545) rituximab bound to B cells in blood containing 40% serum (only 5.5% of NK cells down regulate surface expression of CD16). However, adding IdeZ to the 40% serum substantially removes the endogenous IgG from binding to NK cell FcγRIIIA (CD16α), and allows the NK cells' CD16 to recognize and bind EETCWDW (SEQ ID NO:545) rituximab bound to B cells in blood resulting in an increase of NK cell activation as measured by a substantial downregulation of CD16α (5.5% in 40% AB serum without IdeZ compared to 22.7% in 40% AB serum with IdeZ).

Example 4: Rituximab Variants

Endogenous IgG in human plasma binds Fcγ receptors (R) on all innate immune cells, limiting the access of the exogenously administered therapeutic antibody to FcγR on natural killer (NK) cells, monocytes, macrophages and granulocytes. Rituximab is a CD20 antibody with the human IgG1 constant region. Rituximab's Fab region binds CD20 on B cells and its Fc region binds FcγRIIIa (CD16) and activates NK cells through antibody-dependent cellular cytotoxicity (ADCC), thereby depleting the benign or malignant B cell population. For ADCC to occur, the therapeutic antibody must bind the FcγR innate immune effector cell with its Fc region and it must bind the antigen on the target cell with its Fab region. The discovery focuses on enhancement of (1) the binding affinity and (2) enhancement of the percent occupancy of the therapeutic antibody's Fc region to the number of FcγR expressed on the surface of the innate immune effector cell. The data herein demonstrate these principles using (1) the well-known therapeutic antibody Rituximab, which binds to CD20 and can deplete both normal and malignant B cells; and (2) the human NK cells as an innate immune cell that bears FcγR. The discoveries/inventions described herein are meant to describe a platform that can be adapted for any therapeutic antibody that engages any immune cells through binding FcγRs for part or all of its function.

One of the challenges with antibody therapy is that it must compete for FcγR binding with the massive amount of endogenous IgG that exists in the human body, and modifications in the hinge region of a therapeutic mAb to improve its binding to FcγR will not fully displace endogenous IgG binding to FcγR on all of the innate immune effector cells. This in turn will limit the therapeutic efficacy of mAb that work via ADCC and/or ADCP. However, it has been demonstrated in humans that intravenous administration of IgG peptidases IdeZ and IdeS cleaves endogenous IgG at the hinge region and completely disrupts endogenous IgG-FcγR binding, leaving the FcγR vacant for binding by the therapeutic mAb. Because so little sequence modification has been focused the IgG hinge region, most all humanized antibodies have the wild type hinge sequence and are therefore sensitive to IdeZ and IdeS cleavage, thus, treatment with IdeZ or IdeS would also cleave the hinge region of the therapeutic mAb. Importantly, the modifications in the hinge region using the CHO cell display produced in any therapeutic mAb strategy can be made to be resistant to cleavage by the IgG peptidases IdeZ and IdeS (FIG. 7 and FIG. 9). Thus, from a practical standpoint, the IgG peptidases IdeZ and IdeS can be administered to patients (Jordan et al.), cleave all endogenous IgG and therefore open all IgG-FcγRs for exclusive binding by the modified mAb, vastly increasing the number of innate immune effector cells armed with the therapeutic mAb and capable of performing ADCC and ADCP. This discovery could therefore dramatically improve the efficacy of therapeutic mAb whose mechanism of action partially or fully occurs via ADCC and ADCP, such as rituximab for the treatment of lymphoma and multiple sclerosis.

The IdeZ (and IdeS) enzyme cuts human IgG1 right after the first glycine of native ELLGGPS amino acid (AA) hinge sequence of endogenous IgG as well as wild type rituximab, thereby removing both endogenous IgG and wild type rituximab from binding Fcγ receptors, canceling NK cell activation (FIG. 11A, top row) and lowering rituximab-mediated B cell depletion by >50% (i.e., 6% to 9.8%; FIG. 11B, top row). IdeZ did not cut the synthesized rituximab with the novel EETCWDW (SEQ ID NO:545) AA hinge sequence (referred to in FIGS. 8 and 9 as "EETCWDW rituximab" (SEQ ID NO:545)). Thus, the presence of IdeZ did not cancel NK cell activation (FIG. 11A, bottom row), and improved ADCC depletion of B cells (FIG. 11A, bottom row). IdeZ-mediated removal of endogenous IgG from binding to Fcγ receptors presumably created more Fcγ receptor binding for the "EETCWDW rituximab" (SEQ ID NO:545) and therefore boosted NK cell ADCC and B cell depletion by 50% compared to wild type rituximab in the absence of IdeZ (FIG. 11B, 3.0% vs 6.0% residual B cells, respectively).

Figure 13:
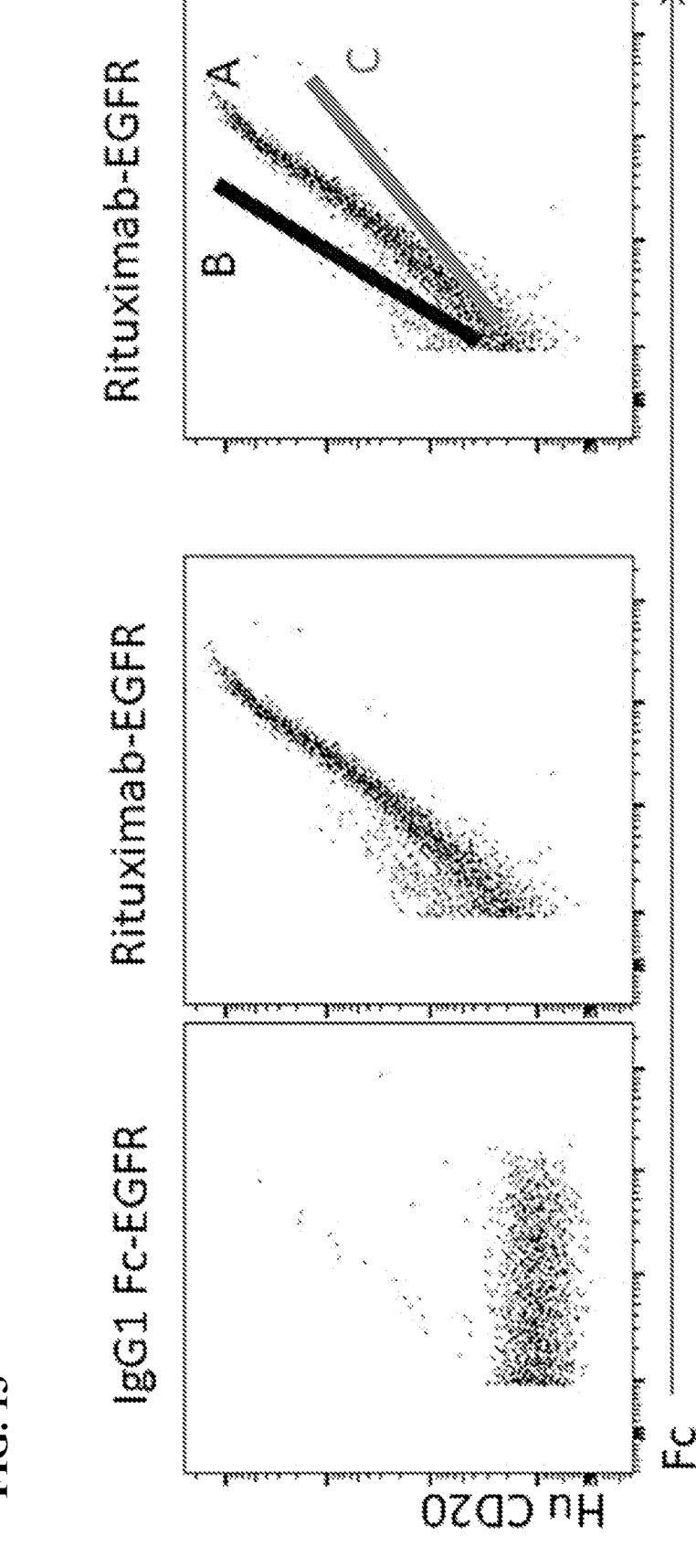
FIG. 13 is data demonstrating rituximab expressed on the surface of CHO cells as rituximab-EGFR fusion protein. The X axis shows a fluorescently labeled anti-Fc mAb that can bind to CHO cells expressing IgG1-EGFR or rituximab-EGFR. The Y axis shows a fluorescently labeled CD20 molecule that can bind to rituximab-EGFR. In the left histogram, the CHO cells express IgG1 Fc-EGFR, thus binding on the X axis but no binding on the Y axis. The middle histogram expresses rituximab-EGFR and quantifies the affinity rituximab has for CD20. The histogram to the right shows the binding of the fluorescently labeled CD20 molecule to rituximab (Line A), or to a hypothetical variant of rituximab with higher affinity for CD20 compared to the actual rituximab (Line B), or to a hypothetical variant of rituximab with lower affinity for CD20 compared to the actual rituximab (Line C). Right panels show the expression of the CH2-CH3 fragment of Fc on the surface of CHO cells, so no binding by the human fluorescently labeled CD20 molecule.

When an NK cell engages a therapeutic monoclonal antibody by binding its Fc region to the NK cell's FcγRIII (CD16) and the Fab region to the target cell, the NK cell is activated, ADCC occurs, and CD16 is downregulated on the surface of the NK cell. As plasma or serum increase, the amount of endogenous IgG increases and competitively inhibits the binding of exogenous therapeutic antibody Fc region to the NK cell's CD16, thereby limiting NK cell's ability to bind the therapeutic antibody and activate to kill the intended target by ADCC (FIG. 12; compare 14.2% downregulation of CD16 in 6.7% serum vs 5.5% downregulation of CD16 in 40% serum). With the addition of IdeZ, endogenous IgG is cleaved and cannot bind to CD16, thereby freeing up CD16 binding sites on the NK cell for the IdeZ-resistant "EETCWDW rituximab" (SEQ ID NO:545) to bind and activate the NK cells despite 40% serum (compare 5.5% downregulation of CD16 in the absence of IdeZ to 22.7% downregulation of CD16 in the presence of IdeZ. This leads to improved depletion of the tumor target, which in this case is the B cell in blood (FIG. 11B). These principles are illustrated for the FcγR on NK cells (CD16), but also apply to the FcγR on monocytes, macrophages (CD16 and CD32α) as well as granulocytes (CD64), each of whose FcγRs are normally occupied by endogenous IgG An affinity selection process was initiated by generating a library of rituximab by introducing random mutations in the region where rituximab binds to CD20 and the many variants are characterized as having increased or decreased affinity to CD20. The variants were expressed on the surface of CHO cells using as EGFR-TMH fusion proteins and assessed for binding affinity of each variant toward a fluorescently labeled CD20 (FIG. 13). The data in FIG. 13 demonstrates rituximab expressed on the surface of CHO cells as rituximab-EGFR fusion protein. The X axis shows a fluorescently labeled anti-Fc mAb that can bind to CHO cells expressing IgG1-EGFR or rituximab-EGFR. The Y axis shows a fluorescently labeled CD20 molecule that can bind to rituximab-EGFR. In the left histogram, the CHO cells express IgG1 Fc-EGFR, thus binding on the X axis but no binding on the Y axis. The middle histogram expresses rituximab-EGFR and quantifies the affinity rituximab has for CD20. The histogram to the right shows the binding of the fluorescently labeled CD20 molecule to rituximab (Line A), or to a hypothetical variant of rituximab with higher affinity for CD20 compared to the actual rituximab (Line B), or to a hypothetical variant of rituximab with lower affinity for CD20 compared to the actual rituximab (Line C). Right panels show the expression of the CH2-CH3 fragment of Fc on the surface of CHO cells, so no binding by the human fluorescently labeled CD20 molecule.

FIG. 14 illustrates flow cytometry density plots of sequence-dependent rituximab target selection and corresponding sequences. The representative example shows multiple clones from the rituximab library consisting of CD20 binding variants and flow cytometric measurement of binding affinity for each variant to a fluorescently labeled CD20 molecule, as demonstrated in FIG. 13.

Rituximab heavy chain CDR1, CDR2, CDR3 and light chain CDR3 are the main regions involved in binding CD20. To test and validate embodiments described herein, a mutation library was made in the heavy chain CDR1, CDR2, and CDR3 respectively, and representative mutants from each library were identified. Those mutants only differ at the specified CDR region. For example, clone A-P01A09 differs from wild type rituximab at heavy chain CDR1, with mutation underlined. Therefore, light chain CDR1, CDR2, and CDR3 are wild type, non-mutated rituximab sequences. Specifically, all variants described herein include wild type rituximab light chain CDR1 (nucleic acid sequence: GCGAGCAGCAGCGTGAGC (SEQ ID NO: 630); amino acid sequence: ASSSVS (SEQ ID NO: 633)), light chain CDR2 (nucleic acid sequence: GGAAGCGGCACCAGC (SEQ ID NO: 631); amino acid sequence: GSGTS (SEQ ID NO: 634)) and light chain CDR3 (nucleic acid sequence: TGGACCAGCAACCCGCCG (SEQ ID NO: 632); amino acid sequence: WTSNPP (SEQ ID NO:635)).

The CDR region variants tested are provided in Tables 1-3 below and FIG. 14. The table indicates the clones created and tested in experiments described herein. Each clone has a variant in a single CDR region with the other CDR regions being wildtype or non-mutated rituximab. In this instance, wildtype is the CDR of the anti-CD20 antibody rituximab. The variation in the CDR as compared to the non-variant or "wildtype" CDR is underlined in the table. For instance, Table 1 shows clones with mutations in CDR1 of rituximab (underlined) and having CDR2 and CDR3 the same as non-mutated (also referred to as wildtype (WT)) rituximab. Each clone in Table 1 has a nucleic acid sequence that encodes rituximab except for the noted CDR change relative to rituximab. For example, clone P01A09 in the first row has a variant heavy chain CDR1 (underlined sequence shows specific differences) relative to rituximab, but heavy chain CDR2 and heavy chain CDR3 are non-mutated sequences relative to rituximab. In addition, P01A09 includes non-mutated light chain CDR1, non-mutated light chain CDR2, non-mutated light chain CDR3. Indeed, the sequence of P01A09 matches the sequence of rituximab except for variant heavy chain CDR1.

TABLE 1

| CLONES | Nucleic Acid Heavy chain CDRI WT: TATACCTTCACAAGCTATAAC (SEQ ID NO: 548) | Amino Acid Heavy chain CDRI WT: YTFTSYN (SEQ ID NO: 589) |
|---|---|---|
| P01A09 | TATACCGGG-GAAGCGGTATAAC (SEQ ID NO: 551) | YTGKRYN (SEQ ID NO: 592) |
| P01B01 | TATACCTGTTTTAGGTATAAC (SEQ ID NO: 552) | YTCFRYN (SEQ ID NO: 593) |
| P02C12 | TATACCTTCACAATTCGTTTG (SEQ ID NO: 553) | YTFTIRL (SEQ ID NO: 594) |
| P02F01 | TATACCGGGCGTTTTTATAAC (SEQ ID NO: 554) | YTGRFYN (SEQ ID NO: 595) |
| P03A05 | TATACCAGTTGGATGTATAAC (SEQ ID NO: 555) | YTSWMYN (SEQ ID NO: 596) |
| P05B09 | TGGTTGTGGACAAGCTATAAC (SEQ ID NO: 556) | WLWTSYN (SEQ ID NO: 597) |
| P05H07 | TATACCTGGGGGATTTATAAC (SEQ ID NO: 557) | YTWGIYN (SEQ ID NO: 598) |
| P04A02 | TATACCTTCACAAGGTATAAT (SEQ ID NO: 558) | YTFTRYN (SEQ ID NO: 599) |
| P05F06 | TATACCTTCACATTTCCTTAT (SEQ ID NO: 559) | YTFTFPY (SEQ ID NO: 600) |
| P07C04 | TATACCGGTATTCGGTATAAC (SEQ ID NO: 560) | YTGIRYN (SEQ ID NO: 601) |

TABLE 2

| | CDR2 Variants | |
|---|---|---|
| CLONES | Nucleic Acid Heavy chain CDR2 WT: ATTTATCCGGGCAACGGCGAT (SEQ ID NO: 549) | Amino Acid Heavy chain CDR2 WT: IYPGNGD (SEQ ID NO: 590) |
| P04D06 | ATTTATCCGGGCTTGTATCTT (SEQ ID NO: 561) | IYPGLYL (SEQ ID NO: 602) |
| P04F01 | ATTTATCCGGGCACGCTGCTG (SEQ ID NO: 562) | IYPGTLL (SEQ ID NO: 603) |
| P04F02 | ATTTATCCGGGCCATATGGGG (SEQ ID NO: 563) | IYPGHMG (SEQ ID NO: 604) |
| P04G03 | ATTTATCCGGGCATGCTTTGG (SEQ ID NO: 564) | IYPGMLW (SEQ ID NO: 605) |
| P04H06 | ATTTATCCGGGCGCTGTTTCG (SEQ ID NO: 565) | IYPGAVS (SEQ ID NO: 606) |
| P04H07 | ATTTATCCGGGCACTCATAAG (SEQ ID NO: 566) | IYPGTHK (SEQ ID NO: 607) |
| P06A06 | ATTTATCCGGGCACTCAGTCT (SEQ ID NO: 567) | IYPGTQS (SEQ ID NO: 608) |
| P06B11 | ATTTATCCGGGCAATGCGGAT (SEQ ID NO: 568) | IYPGNAD (SEQ ID NO: 609) |
| P06H01 | ATTTATCCGGGCAGTTTTGAG (SEQ ID NO: 569) | IYPGSFE (SEQ ID NO: 610) |
| P04D09 | ATTTATCCGGGCACGTTTCTT (SEQ ID NO: 570) | IYPGTFL (SEQ ID NO: 611) |
| P05A03 | ATTTATCCGGTTACGGGCGAT (SEQ ID NO: 571) | IYPVTGD (SEQ ID NO: 612) |

TABLE 2-continued

CDR2 Variants

| CLONES | Nucleic Acid Heavy chain CDR2 WT: ATTTATCCGGGCAACGGCGAT (SEQ ID NO: 549) | Amino Acid Heavy chain CDR2 WT: IYPGNGD (SEQ ID NO: 590) |
|---|---|---|
| P05A12 | ATTTATCCGTATCTGGGCGAT (SEQ ID NO: 572) | IYPYLGD (SEQ ID NO: 613) |
| P05B02 | ATTTATCCGTGGAATGGCGAT (SEQ ID NO: 573) | IYPWNGD (SEQ ID NO: 614) |
| P06B04 | ATTTATCCTCTGTGGGGCGAT (SEQ ID NO: 574) | IYPLWGD (SEQ ID NO: 615) |
| P06B11 | ATTTATCCGGGCAGTAGTCGT (SEQ ID NO: 575) | IYPGSSR (SEQ ID NO: 616) |
| P06H05 | ATTTATCCGGGCACTTTTCGT (SEQ ID NO: 576) | IYPGTFR (SEQ ID NO: 617) |
| P06H11 | ATTTATCCGGGCGTTGGTCGG (SEQ ID NO: 577) | IYPGVGR (SEQ ID NO: 618) |
| P07F02 | ATTTATCCGGGCTCTCAGGCG (SEQ ID NO: 578) | IYPGSEA (SEQ ID NO: 619) |
| P07F10 | ATTTATCCGGGCAGTAATATG (SEQ ID NO: 579) | IYPGSNM (SEQ ID NO: 620) |
| P08B05 | ATTTATCCGGGCGCTTTTCTT (SEQ ID NO: 580) | IYPGAFL (SEQ ID NO: 621) |

TABLE 3

[CDR3 Variants

| CLONES | Nucleic Acid Heavy chain CDR3 WT: CGCAGCACCTATTATGGCGG CGATTGGTATTTTAAC (SEQ ID NO: 550) | Amino Acid Heavy chain CDR3 WT: RSTYYGGDWYFN (SEQ ID NO: 591) |
|---|---|---|
| P07C02 | CAGTCTATTTATTATGGCGG CGATTGGTATTTTAAC (SEQ ID NO: 581) | QSIYYGGDWYFN (SEQ ID NO: 622) |
| P07H08 | CGCAGCACCTATTATGGCGG CGATTGGCTGATTGCT (SEQ ID NO: 582) | RSTYYGGDWLIA (SEQ ID NO: 623) |
| P07H10 | CGCAGCACCGTGGCGGGGGG CGATTGGTATTTTAAC (SEQ ID NO: 583) | RSTVAGGDWYFN (SEQ ID NO: 624) |
| P08A01 | CGCAGCACCTATTATGGCGG CGATTGGCGGTGGCGG (SEQ ID NO: 584) | RSTYYGGDWRWR (SEQ ID NO: 625) |
| P08B11 | CGCAGCACCTATTATGGCGG GTTTTGGTATTTTAAC (SEQ ID NO: 585) | RSTYYGGFWYFN (SEQ ID NO: 626) |
| P08G02 | CGCAGCACCTATTATGGCGG CGATTGGTCTTGGGCT (SEQ ID NO: 586) | RSTYYGGDWSWA (SEQ ID NO: 627) |
| P07A06 | CGCAGCACCATGTGTAAGGG CGATTGGTATTTTAAC (SEQ ID NO: 587) | RSTMCKGDWYFN (SEQ ID NO: 628) |
| P08E05 | CGCAGCACCATGTTGGGTGG CGATTGGTATTTTAAC (SEQ ID NO: 588) | RSTMLGGDWYFN (SEQ ID NO: 629) |

Figure 15:
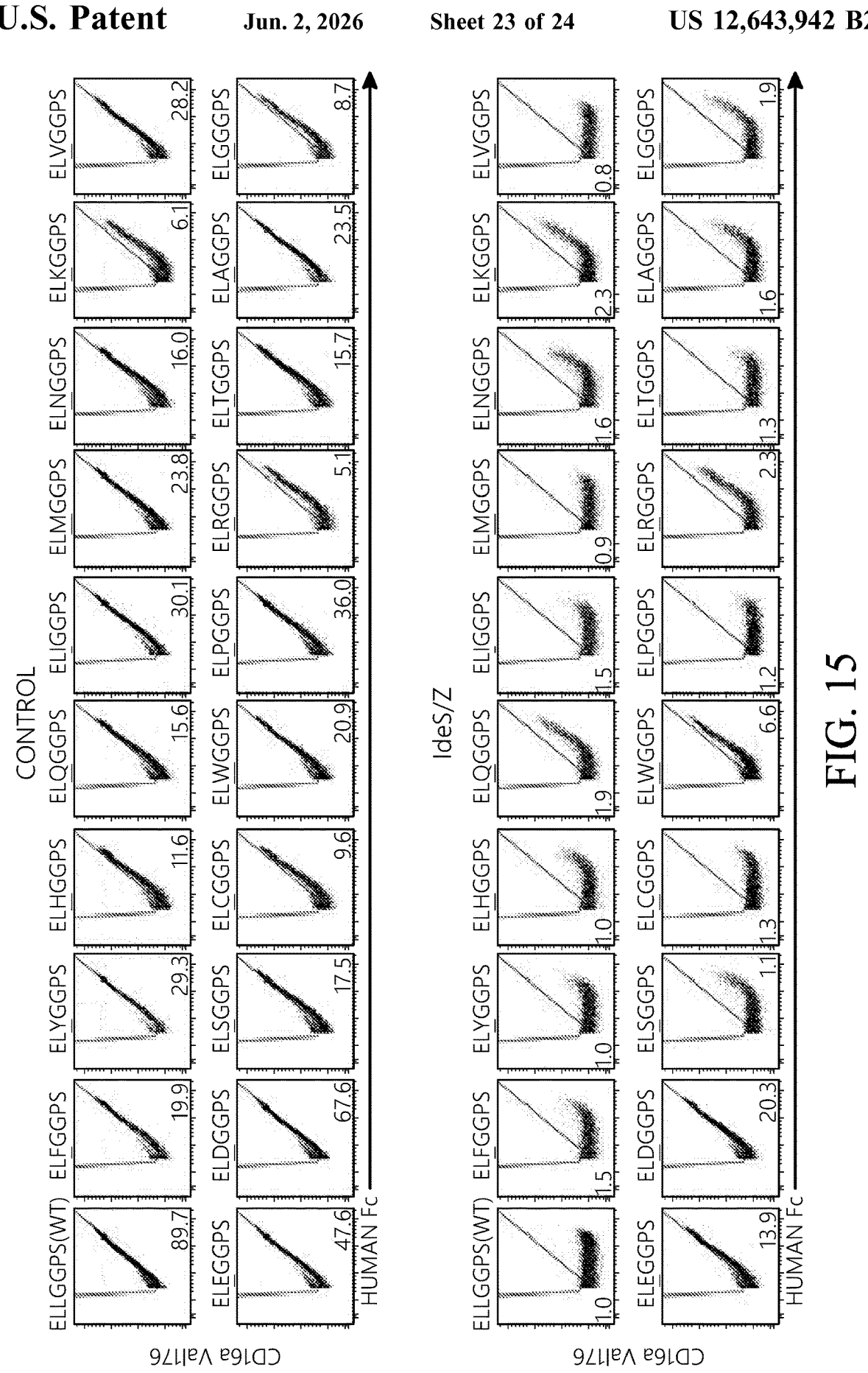
FIG. 15 illustrates the progressive acquisition of IdeS resistance by single amino acid substitution. Top row shows (from left to right) SEQ ID NOs: 544, 661, 662, 663, 664, 665, 666, 667, 668, and 669. Second row from top shows (from left to right) SEQ ID NOs: 670, 671, 672, 673, 674, 675, 676, 677, 678, and 679. Third row from top shows (from left to right) SEQ ID NOs: 544, 661, 662, 663, 664, 665, 666, 667, 668, and 669. Bottom row shows (from left to right) SEQ ID NOs: 670, 671, 672, 673, 674, 675, 676, 677, 678, and 679.

FIG. 15 illustrates the progressive acquisition of IdeS resistance by single amino acid substitution. The first leucine (L248) upstream of IdeS/Z cleavage site was mutated to the other 19 amino acids individually. Wild-type or single amino acid mutants of rituximab were expressed on CHO cells as type I membrane proteins and tested for their expression and binding to human CD16α using fluorescent labeled anti-human IgG Fc and CD16α ectodomain. The L248E and L248D mutations acquired significant IdeS resistance with only slight loss of CD16α binding.

Figure 16:
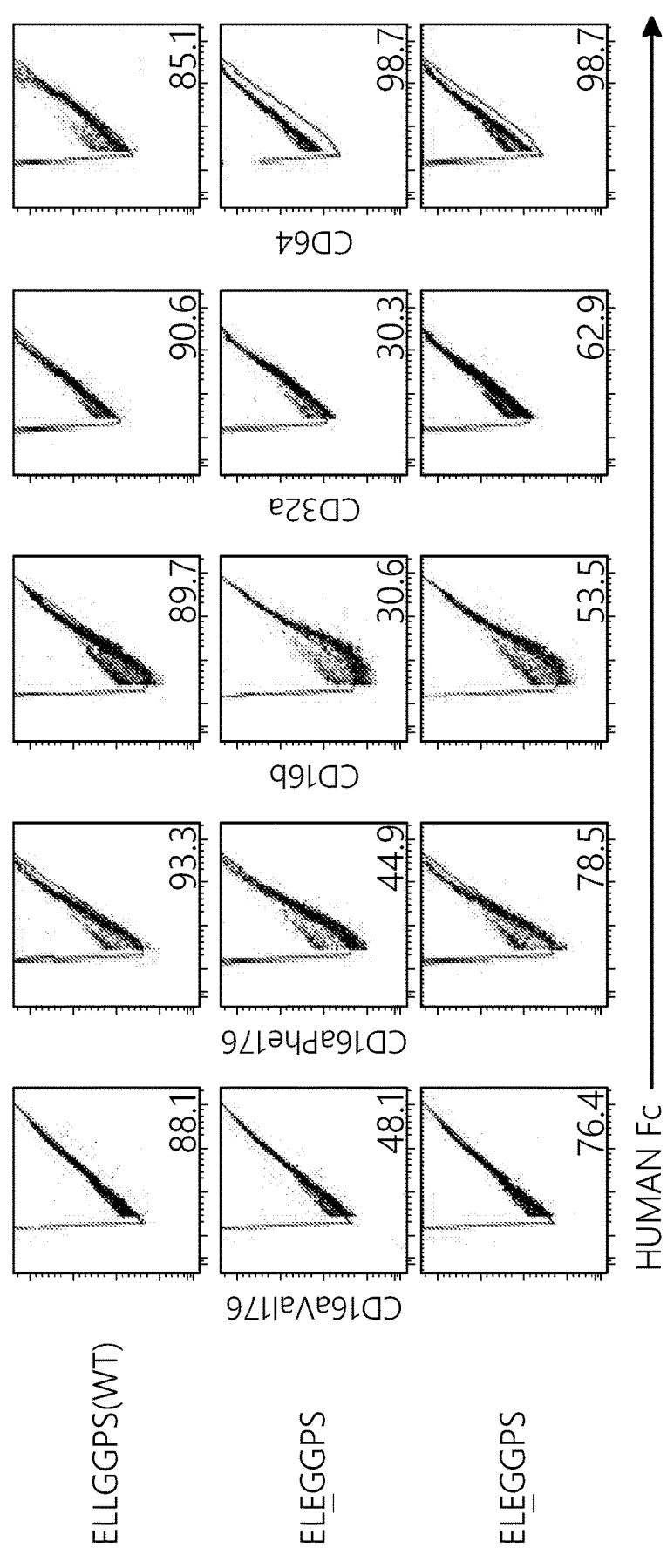
FIG. 16 illustrates the binding of wild-type, L248E, and L248D hinge mutant rituximab to human FcγRs. Wild-type (top panel; SEQ ID NO:544) or the single amino acid mutants of rituximab (L248E and L248E), middle panel (SEQ ID NO:670) and bottom panel (SEQ ID NO: 671), respectively, were expressed on CHO cells as type I membrane proteins and tested for their expression and binding to human FcγRs using fluorescent labeled anti-human Fc and different human FcγR ectodomains.

FIG. 16 illustrates the binding of wild-type, L248E, and L248D hinge mutant rituximab to human FcγRs. Wild-type or the single amino acid mutants of rituximab (L248E and L248E) were expressed on CHO cells as type I membrane proteins and tested for their expression and binding to human FcγRs using fluorescent labeled anti-human Fc and different human FcγR ectodomains. The L248E and L248D mutations had a slight decrease in affinity for CD16α, CD16β, and CD32α, and had an increase in affinity for CD64 as compared to the wild-type protein.

REFERENCES

1. Chen Zhou, Frederick W Jacobsen, Ling Cai, Qing Chen, and Weyen David Shen. Development of a novel mammalian cell surface antibody display platform. MAbs. 2010 September-October; 2 (5): 508-518.

2. Cumbers S J, Williams G T, Davies S L, Grenfell R L, Takeda S, Batista F D, et al. Generation and iterative affinity maturation of antibodies in vitro using hypermutating B-cell lines. Nat Biotechnol. 2002; 20:1129-1134.

3. Ho M, Nagata S, Pastan I. Isolation of anti-CD22 Fv with high affinity by Fv display on human cells. P Natl Acad Sci USA. 2006; 102:9637-9642.

4. Urban J H, Schneider R M, Compe M, Finger C, Cichutek K, Alvarez-Vallina L, et al. Selection of functional human antibodies from retroviral display libraries. Nucleic Acids Res. 2005:33-35.

5 Wolkowicz R, Jager G C, Nolan G P. A random peptide library fused to CCR5 for selection of mimetopes expressed on the mammalian cell surface via retroviral vectors. J Biol Chem. 2005; 280:15195-15201.

6. Zauderer M, Smith E S. In vitro methods of producing and identifying immunoglobulin molecules in eukaryotic cells. U S patent application 2002-0123057A1.

7. Akamatsu Y, Pakabunto K, Xu Z, Zhang Y, Tsurushia N. Whole IgG surface display on mammalian cells: Application to isolation of neutralizing chicken monoclonal anti-IL-12 antibodies. J Immunol Methods. 2007; 327: 40-52.

8. Beerli R R, Bauer M, Buser R B, Gwerder M, Muntwiler S, Maurer P, et al. Isolation of human monoclonal antibodies by mammalian cell display. P Natl Acad Sci USA. 2008; 105:14336-14341.

9. Higuchi K, Araki T, Matsuzaki O, Sato A, Kanno K, Kitaguchi N, et al. Cell display library for gene cloning of variable regions of human antibodies to hepatitis B surface antigen. J Immunol Methods. 1997; 202:193-204.

10. Jordan et al N Engl J Med 2017; 377:442-453; 2017.

SEQUENCE LISTING (680 sequences)

SEQ ID NO: 1 - DNA, 705 bp, Artificial sequence
  Synthetic polynucleotide
  misc_feature: Rituximab light chain, DNA
atggccctccctgtcaccgccctgctgcttccgctggctcttctgctccacgccgctcggccccagattgtgctgagccagagcccggcgattctgagcgcgagcccgggcgaaaaagtgaccatgacctgccgcgcgagcagcagcgtgagctatattcattggtttcagcagaaaccgggcagcagcccgaaaccgtggatttatgcgaccagcaacctggcgagcggcgtgccggtgcgctttagcggctcaggaagcggcaccagctatagcctgaccattagccgcgtggaagcggaagatgcggcgacctattattgccagcagtggaccagcaacccgccgacctttggcggcggcaccaaactggaaattaaacgcacggtggcggctccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2 - DNA, 1413 bp, Artificial sequence
  Synthetic polynucleotide
  misc_feature: Rituximab heavy chain, DNA
atggactggacctggaggatcctcttcttggtggcagccgctacaggcgcgcactcccaagtacaactacaacaacctggtgcagaactggttaaaccaggtgcaagtgtgaaaatgagctgcaaagcgagcggctataccttcacaagctataacatgcattgggtgaaacagaccccgggccgcggcctggaatggattggcgcgatttatccgggcaacggcgataccagctataaccagaaatttaaaggcaaagcgaccctgaccgcggataaaagcagcagcaccgcgtatatgcagctgagcagcctgaccagcgaagatagcgcggtgtattattgcgcgcgcagcacctattatggcggcgattggtattttaacgtgtggggcgcgggcaccaccgtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaagtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagtctctccctgtctccgggtaaatga

SEQ ID NO: 3 - protein, 234 aa, Artificial sequence
  Synthetic polypeptide
  misc_feature: Rituximab light chain, amino acid
MALPVTALLLPLALLLHAARPQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4 - protein, 470 aa, Artificial sequence
  Synthetic polypeptide
  misc_feature: Rituximab heavy chain, amino acid
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - DNA, 132 bp, Artificial sequence
  Synthetic polynucleotide
  misc_feature: EGFR transmembrane sequence, DNA
gaaggctgtccaacgaatgggcctaagatcccgtccatcgccactgggatggtgggggccctcctcttgctgctggtggtggccctggggatcggcctcttcatgcgaaggcgccacatcgttcggaagcgc

SEQ ID NO: 6 - protein, 44 aa, Artificial sequence
  Synthetic polypeptide
  misc_feature: EGFR transmembrane sequence, amino acid
EGCPTNGPKIPSIATGMVGALLLLLVVALGIGLFMRRRHIVRKR

SEQ ID NO: 7 - DNA, 63 bp, Artificial sequence
  Synthetic polynucleotide
  misc_feature: signal peptide, DNA
atggccctccctgtcaccgccctgctgcttccgctggctcttctgctccacgccgctcggccc

SEQ ID NO: 8 - protein, 21 aa, Artificial sequence
  Synthetic polypeptide
  misc_feature: signal peptide, amino acid
MALPVTALLLPLALLLHAARP

SEQ ID NO: 9 - DNA, 1542 bp, Artificial sequence
  Synthetic polynucleotide
  misc_feature: rituximab heavy chain-EGFR, DNA
atggactggacctggaggatcctcttcttggtggcagccgctacaggcgcgcactcccaagtacaactacaacaacctggtgcagaactggttaaaccaggtgcaagtgtgaaaatgagctgcaaagcgagcggctataccttcacaagctataacatgcattgggtgaaacagaccccgggccgcggcctggaatggattggcgcgatttatccgggcaacggcgataccagctataaccagaaatttaaaggcaaagcgaccctgaccgcggataaaagcagcagcaccgcgtatatgcagctgagcagcctgaccagcgaagatagcgcggtgtattattgcgcgcgcagcacctattatggcggcgattggtattttaacgtgtggggcgcgggcaccaccgtgaccgtgagcgcggctagcaccaagggcccatcggtcttccccctggcaccctcctccaagagcacctctgggggcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaagtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagtctctccctgtctccgggtaaagaaggctgtccaacgaatgggcctaagatcccgtccatcgccactgggatggtgggggccctcctcttgctgctggtggtggccctggggatcggcctcttcatgcgaaggcgccacatcgttcggaagcgc

SEQ ID NO: 10 - protein, 514 aa, Artificial sequence
  Synthetic polypeptide
  misc_feature: rituximab heavy chain-EGFR, amino acid
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEGCPTNGPKIPSIATGMVGALLLLLVVALGIGLFMRRRHIVRKR

SEQ ID NO: 11 - DNA, 690 bp, Artificial sequence
  Synthetic polynucleotide
  misc_feature: IgG1Fc, DNA
gagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccg

SEQ ID NO: 12 - protein, 230 aa, Artificial sequence
  Synthetic polypeptide
  misc_feature: IgG1Fc, amino acid
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 13 - DNA, 822 bp, Artificial sequence
  Synthetic polynucleotide
  misc_feature: IgG1Fc-EGFR, DNA
gagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggaaggctgtccaacgaatgggcctaagatcccgtccatcgccactgggatggtgggggccctcctcttgctgctggtggtggccctggggatcggcctcttcatgcgaaggcgccacatcgttcggaagcgc

SEQ ID NO: 14 - protein, 274 aa, Artificial sequence
  Synthetic polypeptide
  misc_feature: IgG1Fc-EGFR, amino acid
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 15 - DNA, 624 bp, Artificial sequence
  Synthetic polynucleotide
  misc_feature: IgG1FcDelta16, DNA
gtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaagtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagtctctccctgtctccgggtaaa

SEQ ID NO: 16 - protein, 208 aa, Artificial sequence
  Synthetic polypeptide
  misc_feature: IgG1FcDelta16, amino acid
VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - DNA, 750 bp, Artificial sequence
  Synthetic polynucleotide
  misc_feature: IgG1FcDELTA16-EGFR, DNA
gtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccggaaggctgtccaacgaatgggcctaagatcccgtccatcgccactgggatggtgggggccctcctcttgctgctggtggtggccctggggatcggcctcttcatgcgaaggcgccacatcgttcggaagcgc

SEQ ID NO: 18 - protein, 250 aa, Artificial sequence
  Synthetic polypeptide
  misc_feature: IgG1FcDELTA16-EGFR, amino acid
VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 19 - protein, 251 aa, Artificial sequence
  Synthetic polypeptide
  misc_feature: IgG1FcDELTA16_S, amino acid
SVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 20 - protein, 251 aa, Artificial sequence
  Synthetic polypeptide
  misc_feature: IgG1FcDELTA16_F, amino acid
FVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 21 - protein, 251 aa, Artificial sequence
  Synthetic polypeptide
  misc_feature: IgG1FcDELTA16_Y, amino acid
YVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 22 - protein, 251 aa, Artificial sequence
  Synthetic polypeptide
  misc_feature: IgG1FcDELTA16_L, amino acid
LVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 23 - protein, 251 aa, Artificial sequence
  Synthetic polypeptide
  misc_feature: IgG1FcDELTA16_H, amino acid
HVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 24 - protein, 251 aa, Artificial sequence
  Synthetic polypeptide
  misc_feature: IgG1FcDELTA16_Q, amino acid
QVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 25 - protein, 251 aa, Artificial sequence
  Synthetic polypeptide
  misc_feature: IgG1FcDELTA16_I, amino acid
IVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 26 - protein, 251 aa, Artificial sequence
  Synthetic polypeptide
  misc_feature: IgG1FcDELTA16_M, amino acid
MVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 27 - protein, 251 aa, Artificial sequence
  Synthetic polypeptide
  misc_feature: IgG1FcDELTA16_N, amino acid
NVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 28 - protein, 251 aa, Artificial sequence
  Synthetic polypeptide
  misc_feature: IgG1FcDELTA16_K, amino acid
KVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 29 - protein, 251 aa, Artificial sequence
  Synthetic polypeptide
  misc_feature: IgG1FcDELTA16_V, amino acid
VVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 30 - protein, 251 aa, Artificial sequence
  Synthetic polypeptide
  misc_feature: IgG1FcDELTA16_E, amino acid
EVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 31 - protein, 251 aa, Artificial sequence
  Synthetic polypeptide
  misc_feature: IgG1FcDELTA16_D, amino acid
DVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 32 - protein, 251 aa, Artificial sequence
  Synthetic polypeptide
  misc_feature: IgG1FcDELTA16_C, amino acid
CVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 33 - protein, 251 aa, Artificial sequence
  Synthetic polypeptide
  misc_feature: IgG1FcDELTA16_W, amino acid
WVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 34 - protein, 251 aa, Artificial sequence
  Synthetic polypeptide
  misc_feature: IgG1FcDELTA16_P, amino acid
PVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 35 - protein, 251 aa, Artificial sequence
  Synthetic polypeptide
  misc_feature: IgG1FcDELTA16_R, amino acid
RVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 36 - protein, 251 aa, Artificial sequence
  Synthetic polypeptide
  misc_feature: IgG1FcDELTA16_T, amino acid
TVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 37 - protein, 251 aa, Artificial sequence
  Synthetic polypeptide
  misc_feature: IgG1FcDELTA16_A, amino acid
AVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 38 - protein, 251 aa, Artificial sequence
  Synthetic polypeptide
  misc_feature: IgG1FcDELTA16_G, amino acid
GVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 39 - protein, 252 aa, Artificial sequence
  Synthetic polypeptide
  misc_feature: IgG1FcDELTA16_SS, amino acid
SSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 40 - protein, 252 aa, Artificial sequence
  Synthetic polypeptide
  misc_feature: IgG1FcDELTA16_FS, amino acid
FSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 41 - protein, 252 aa, Artificial sequence
  Synthetic polypeptide
  misc_feature: IgG1FcDELTA16_YS, amino acid
YSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 42 - protein, 252 aa, Artificial sequence
  Synthetic polypeptide
  misc_feature: IgG1FcDELTA16_LS, amino acid
LSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 43 - protein, 252 aa, Artificial sequence
  Synthetic polypeptide
  misc_feature: IgG1FcDELTA16_HS, amino acid
HSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 44 - protein, 252 aa, Artificial sequence
  Synthetic polypeptide
  misc_feature: IgG1FcDELTA16_QS, amino acid
QSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 45 - protein, 252 aa, Artificial sequence
  Synthetic polypeptide
  misc_feature: IgG1FcDELTA16_IS, amino acid
ISVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 46 - protein, 252 aa, Artificial sequence
  Synthetic polypeptide
  misc_feature: IgG1FcDELTA16_MS, amino acid
MSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 47 - protein, 252 aa, Artificial sequence
  Synthetic polypeptide
  misc_feature: IgG1FcDELTA16_NS, amino acid
NSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 48 - protein, 252 aa, Artificial sequence
  Synthetic polypeptide
  misc_feature: IgG1FcDELTA16_KS, amino acid
KSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 49 - protein, 252 aa, Artificial sequence
  Synthetic polypeptide
  misc_feature: IgG1FcDELTA16_VS, amino acid
VSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 50 - protein, 252 aa, Artificial sequence
  Synthetic polypeptide
  misc_feature: IgG1FcDELTA16_ES, amino acid
ESVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 51 - protein, 252 aa, Artificial sequence
  Synthetic polypeptide
  misc_feature: IgG1FcDELTA16_DS, amino acid
DSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 52 - protein, 252 aa, Artificial sequence
  Synthetic polypeptide
  misc_feature: IgG1FcDELTA16_CS, amino acid
CSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 53 - protein, 252 aa, Artificial sequence
  Synthetic polypeptide
  misc_feature: IgG1FcDELTA16_WS, amino acid
WSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 54 - protein, 252 aa, Artificial sequence
  Synthetic polypeptide
  misc_feature: IgG1FcDELTA16_PS, amino acid
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 55 - protein, 252 aa, Artificial sequence
  Synthetic polypeptide
  misc_feature: IgG1FcDELTA16_RS, amino acid
RSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 56 - protein, 252 aa, Artificial sequence
  Synthetic polypeptide
  misc_feature: IgG1FcDELTA16_TS, amino acid
TSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 57 - protein, 252 aa, Artificial sequence
  Synthetic polypeptide
  misc_feature: IgG1FcDELTA16_AS, amino acid
ASVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 58 - protein, 252 aa, Artificial sequence
  Synthetic polypeptide
  misc_feature: IgG1FcDELTA16_GS, amino acid
GSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 59 - protein, 257 aa, Artificial sequence
  Synthetic polypeptide
  misc_feature: IgG1FcDELTA16_ELLGGPS
ELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 60 - protein, 256 aa, Artificial sequence
  Synthetic polypeptide
  misc_feature: IgG1FcDELTA16_LLGGPS
LLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 61 - protein, 255 aa, Artificial sequence
  Synthetic polypeptide
  misc_feature: IgG1FcDELTA16_LGGPS
LGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 62 - protein, 254 aa, Artificial sequence
  Synthetic polypeptide
  misc_feature: IgG1FcDELTA16_GGPS
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 63 - protein, 253 aa, Artificial sequence
  Synthetic polypeptide
  misc_feature: IgG1FcDELTA16_GPS
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 64 - protein, 253 aa, Artificial sequence
  Synthetic polypeptide
  misc_feature: IgG1FcDELTA16_SDW
SDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 65 - protein, 253 aa, Artificial sequence
  Synthetic polypeptide
  misc_feature: IgG1FcDELTA16_FDW
FDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 66 - protein, 253 aa, Artificial sequence
  Synthetic polypeptide
  misc_feature: IgG1FcDELTA16_YDW
YDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 67 - protein, 253 aa, Artificial sequence
  Synthetic polypeptide
  misc_feature: IgG1FcDELTA16_LDW
LDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 68 - protein, 253 aa, Artificial sequence
  Synthetic polypeptide
  misc_feature: IgG1FcDELTA16_HDW
HDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 69 - protein, 253 aa, Artificial sequence
  Synthetic polypeptide
  misc_feature: IgG1FcDELTA16_QDW
QDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 70 - protein, 253 aa, Artificial sequence
  Synthetic polypeptide
  misc_feature: IgG1FcDELTA16_IDW
IDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 71 - protein, 253 aa, Artificial sequence
  Synthetic polypeptide
  misc_feature: IgG1FcDELTA16_MDW
MDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 72 - protein, 253 aa, Artificial sequence
  Synthetic polypeptide
  misc_feature: IgG1FcDELTA16_NDW
NDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 73 - protein, 253 aa, Artificial sequence
  Synthetic polypeptide
  misc_feature: IgG1FcDELTA16_KDW
KDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 74 - protein, 253 aa, Artificial sequence
  Synthetic polypeptide
  misc_feature: IgG1FcDELTA16_VDW
VDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 75 - protein, 253 aa, Artificial sequence
  Synthetic polypeptide
  misc_feature: IgG1FcDELTA16_EDW
EDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 76 - protein, 253 aa, Artificial sequence
  Synthetic polypeptide
  misc_feature: IgG1FcDELTA16_DDW
DDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 77 - protein, 253 aa, Artificial sequence
  Synthetic polypeptide
  misc_feature: IgG1FcDELTA16_CDW
CDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 78 - protein, 253 aa, Artificial sequence
  Synthetic polypeptide
  misc_feature: IgG1FcDELTA16_WDW
WDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 79 - protein, 253 aa, Artificial sequence
  Synthetic polypeptide
  misc_feature: IgG1FcDELTA16_PDW
PDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 80 - protein, 253 aa, Artificial sequence
  Synthetic polypeptide
  misc_feature: IgG1FcDELTA16_RDW
RDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 81 - protein, 253 aa, Artificial sequence
  Synthetic polypeptide
  misc_feature: IgG1FcDELTA16_TDW
TDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 82 - protein, 253 aa, Artificial sequence
  Synthetic polypeptide
  misc_feature: IgG1FcDELTA16_ADW
ADWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 83 - protein, 253 aa, Artificial sequence
  Synthetic polypeptide
  misc_feature: IgG1FcDELTA16_GDW
GDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 84 - protein, 255 aa, Artificial sequence
  Synthetic polypeptide
  misc_feature: IgG1FcDELTA16_SCWDW
SCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 85 - protein, 255 aa, Artificial sequence
  Synthetic polypeptide
  misc_feature: IgG1FcDELTA16_FCWDW
FCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 86 - protein, 255 aa, Artificial sequence
  Synthetic polypeptide
  misc_feature: IgG1FcDELTA16_YCWDW
YCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 87 - protein, 255 aa, Artificial sequence
  Synthetic polypeptide
  misc_feature: IgG1FcDELTA16_LCWDW
LCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 88 - protein, 255 aa, Artificial sequence
  Synthetic polypeptide
  misc_feature: IgG1FcDELTA16_HCWDW
HCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 89 - protein, 255 aa, Artificial sequence
  Synthetic polypeptide
  misc_feature: IgG1FcDELTA16_QCWDW
QCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 90 - protein, 255 aa, Artificial sequence
  Synthetic polypeptide
  misc_feature: IgG1FcDELTA16_ICWDW
ICWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 91 - protein, 255 aa, Artificial sequence
  Synthetic polypeptide
  misc_feature: IgG1FcDELTA16_MCWDW
MCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 92 - protein, 255 aa, Artificial sequence
  Synthetic polypeptide
  misc_feature: IgG1FcDELTA16_NCWDW
NCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 93 - protein, 255 aa, Artificial sequence
  Synthetic polypeptide
  misc_feature: IgG1FcDELTA16_KCWDW
KCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 94 - protein, 255 aa, Artificial sequence
  Synthetic polypeptide
  misc_feature: IgG1FcDELTA16_VCWDW
VCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 95 - protein, 255 aa, Artificial sequence
  Synthetic polypeptide
  misc_feature: IgG1FcDELTA16_ECWDW
ECWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 96 - protein, 255 aa, Artificial sequence
  Synthetic polypeptide
  misc_feature: IgG1FcDELTA16_DCWDW
DCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 97 - protein, 255 aa, Artificial sequence
  Synthetic polypeptide
  misc_feature: IgG1FcDELTA16_CCWDW
CCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 98 - protein, 255 aa, Artificial sequence
  Synthetic polypeptide
  misc_feature: IgG1FcDELTA16_WCWDW
WCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 99 - protein, 255 aa, Artificial sequence
  Synthetic polypeptide
  misc_feature: IgG1FcDELTA16_PCWDW
PCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 100 - protein, 255 aa, Artificial sequence
  Synthetic polypeptide
  misc_feature: IgG1FcDELTA16_RCWDW
RCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 101 - protein, 255 aa, Artificial sequence
  Synthetic polypeptide
  misc_feature: IgG1FcDELTA16_TCWDW
TCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 102 - protein, 255 aa, Artificial sequence
  Synthetic polypeptide
  misc_feature: IgG1FcDELTA16_ACWDW
ACWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 103 - protein, 255 aa, Artificial sequence
  Synthetic polypeptide
  misc_feature: IgG1FcDELTA16_GCWDW
GCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 104 - protein, 254 aa, Artificial sequence
  Synthetic polypeptide
  misc_feature: IgG1FcDELTA16_CWDW
CWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 105 - protein, 256 aa, Artificial sequence
  Synthetic polypeptide
  misc_feature: IgG1FcDELTA16_ETCWDW
ETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 106 - protein, 256 aa, Artificial sequence
  Synthetic polypeptide
  misc_feature: IgG1FcDELTA16_DDCWDW
DDCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 107 - protein, 256 aa, Artificial sequence
  Synthetic polypeptide
  misc_feature: IgG1FcDELTA16_YDCWDW
YDCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 108 - protein, 252 aa, Artificial sequence
  Synthetic polypeptide
  misc_feature: IgG1FcDELTA16_SD
SDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 109 - protein, 252 aa, Artificial sequence
  Synthetic polypeptide
  misc_feature: IgG1FcDELTA16_FD
FDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 110 - protein, 252 aa, Artificial sequence
  Synthetic polypeptide
  misc_feature: IgG1FcDELTA16_YD
YDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 111 - protein, 252 aa, Artificial sequence
  Synthetic polypeptide
  misc_feature: IgG1FcDELTA16_LD
LDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 112 - protein, 252 aa, Artificial sequence
  Synthetic polypeptide
  misc_feature: IgG1FcDELTA16_HD
HDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 113 - protein, 252 aa, Artificial sequence
  Synthetic polypeptide
  misc_feature: IgG1FcDELTA16_QD
QDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 114 - protein, 252 aa, Artificial sequence
  Synthetic polypeptide
  misc_feature: IgG1FcDELTA16_ID
IDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 115 - protein, 252 aa, Artificial sequence
  Synthetic polypeptide
  misc_feature: IgG1FcDELTA16_MD
MDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 116 - protein, 252 aa, Artificial sequence
  Synthetic polypeptide
  misc_feature: IgG1FcDELTA16_ND
NDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 117 - protein, 252 aa, Artificial sequence
  Synthetic polypeptide
  misc_feature: IgG1FcDELTA16_KD
KDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 118 - protein, 252 aa, Artificial sequence
  Synthetic polypeptide
  misc_feature: IgG1FcDELTA16_VD
VDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 119 - protein, 252 aa, Artificial sequence
  Synthetic polypeptide
  misc_feature: IgG1FcDELTA16_ED
EDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 120 - protein, 252 aa, Artificial sequence
  Synthetic polypeptide
  misc_feature: IgG1FcDELTA16_DD
DDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 121 - protein, 252 aa, Artificial sequence
  Synthetic polypeptide
  misc_feature: IgG1FcDELTA16_CD
CDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 122 - protein, 252 aa, Artificial sequence
  Synthetic polypeptide
  misc_feature: IgG1FcDELTA16_WD
WDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 123 - protein, 252 aa, Artificial sequence
  Synthetic polypeptide
  misc_feature: IgG1FcDELTA16_PD
PDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 124 - protein, 252 aa, Artificial sequence
  Synthetic polypeptide
  misc_feature: IgG1FcDELTA16_RD
RDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 125 - protein, 252 aa, Artificial sequence
  Synthetic polypeptide
  misc_feature: IgG1FcDELTA16_TD
TDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 126 - protein, 252 aa, Artificial sequence
  Synthetic polypeptide
  misc_feature: IgG1FcDELTA16_AD
ADVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 127 - protein, 252 aa, Artificial sequence
  Synthetic polypeptide
  misc_feature: IgG1FcDELTA16_GD
GDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 128 - protein, 252 aa, Artificial sequence
  Synthetic polypeptide
  misc_feature: IgG1FcDELTA16_SW
SWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 129 - protein, 252 aa, Artificial sequence
  Synthetic polypeptide
  misc_feature: IgG1FcDELTA16_FW
FWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 130 - protein, 252 aa, Artificial sequence
  Synthetic polypeptide
  misc_feature: IgG1FcDELTA16_YW
YWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 131 - protein, 252 aa, Artificial sequence
  Synthetic polypeptide
  misc_feature: IgG1FcDELTA16_LW
LWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 132 - protein, 252 aa, Artificial sequence
  Synthetic polypeptide
  misc_feature: IgG1FcDELTA16_HW
HWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 133 - protein, 252 aa, Artificial sequence
  Synthetic polypeptide
  misc_feature: IgG1FcDELTA16_QW
QWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 134 - protein, 252 aa, Artificial sequence
  Synthetic polypeptide
  misc_feature: IgG1FcDELTA16_IW
IWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 135 - protein, 252 aa, Artificial sequence
  Synthetic polypeptide
  misc_feature: IgG1FcDELTA16_MW
MWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 136 - protein, 252 aa, Artificial sequence
  Synthetic polypeptide
  misc_feature: IgG1FcDELTA16_NW
NWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 137 - protein, 252 aa, Artificial sequence
  Synthetic polypeptide
  misc_feature: IgG1FcDELTA16_KW
KWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 138 - protein, 252 aa, Artificial sequence
  Synthetic polypeptide
  misc_feature: IgG1FcDELTA16_VW
VWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 139 - protein, 252 aa, Artificial sequence
  Synthetic polypeptide
  misc_feature: IgG1FcDELTA16_EW
EWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 140 - protein, 252 aa, Artificial sequence
  Synthetic polypeptide
  misc_feature: IgG1FcDELTA16_DW
DWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 141 - protein, 252 aa, Artificial sequence
  Synthetic polypeptide
  misc_feature: IgG1FcDELTA16_CW
CWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 142 - protein, 252 aa, Artificial sequence
  Synthetic polypeptide
  misc_feature: IgG1FcDELTA16_WW
WWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 143 - protein, 252 aa, Artificial sequence
  Synthetic polypeptide
  misc_feature: IgG1FcDELTA16_PW
PWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 144 - protein, 252 aa, Artificial sequence
  Synthetic polypeptide
  misc_feature: IgG1FcDELTA16_RW
RWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 145 - protein, 252 aa, Artificial sequence
  Synthetic polypeptide
  misc_feature: IgG1FcDELTA16_TW
TWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 146 - protein, 252 aa, Artificial sequence
  Synthetic polypeptide
  misc_feature: IgG1FcDELTA16_AW
AWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 147 - protein, 252 aa, Artificial sequence
  Synthetic polypeptide
  misc_feature: IgG1FcDELTA16_GW
GWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 148 - protein, 252 aa, Artificial sequence
  Synthetic polypeptide
  misc_feature: IgG1FcDELTA16_SE
SEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 149 - protein, 252 aa, Artificial sequence
  Synthetic polypeptide
  misc_feature: IgG1FcDELTA16_FE
FEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 150 - protein, 252 aa, Artificial sequence
  Synthetic polypeptide
  misc_feature: IgG1FcDELTA16_YE
YEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 151 - protein, 252 aa, Artificial sequence
  Synthetic polypeptide
  misc_feature: IgG1FcDELTA16_LE
LEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 152 - protein, 252 aa, Artificial sequence
  Synthetic polypeptide
  misc_feature: IgG1FcDELTA16_HE
HEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 153 - protein, 252 aa, Artificial sequence
  Synthetic polypeptide
  misc_feature: IgG1FcDELTA16_QE
QEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 154 - protein, 252 aa, Artificial sequence
  Synthetic polypeptide
  misc_feature: IgG1FcDELTA16_IE
IEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 155 - protein, 252 aa, Artificial sequence
  Synthetic polypeptide
  misc_feature: IgG1FcDELTA16_ME
MEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 156 - protein, 252 aa, Artificial sequence
  Synthetic polypeptide
  misc_feature: IgG1FcDELTA16_NE
NEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 157 - protein, 252 aa, Artificial sequence
  Synthetic polypeptide
  misc_feature: IgG1FcDELTA16_KE
KEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 158 - protein, 252 aa, Artificial sequence
  Synthetic polypeptide
  misc_feature: IgG1FcDELTA16_VE
VEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 159 - protein, 252 aa, Artificial sequence
  Synthetic polypeptide
  misc_feature: IgG1FcDELTA16_EE
EEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 160 - protein, 252 aa, Artificial sequence
  Synthetic polypeptide
  misc_feature: IgG1FcDELTA16_DE
DEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 161 - protein, 252 aa, Artificial sequence
  Synthetic polypeptide
  misc_feature: IgG1FcDELTA16_CE
CEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 162 - protein, 252 aa, Artificial sequence
  Synthetic polypeptide
  misc_feature: IgG1FcDELTA16_WE
WEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 163 - protein, 252 aa, Artificial sequence
  Synthetic polypeptide
  misc_feature: IgG1FcDELTA16_PE
PEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 164 - protein, 252 aa, Artificial sequence
  Synthetic polypeptide
  misc_feature: IgG1FcDELTA16_RE
REVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 165 - protein, 252 aa, Artificial sequence
  Synthetic polypeptide
  misc_feature: IgG1FcDELTA16_TE
TEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 166 - protein, 252 aa, Artificial sequence
  Synthetic polypeptide
  misc_feature: IgG1FcDELTA16_AE
AEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 167 - protein, 252 aa, Artificial sequence
  Synthetic polypeptide
  misc_feature: IgG1FcDELTA16_GE
GEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 168 - protein, 252 aa, Artificial sequence
  Synthetic polypeptide
  misc_feature: IgG1FcDELTA16_SQ
SQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 169 - protein, 252 aa, Artificial sequence
  Synthetic polypeptide
  misc_feature: IgG1FcDELTA16_FQ
FQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 170 - protein, 252 aa, Artificial sequence
  Synthetic polypeptide
  misc_feature: IgG1FcDELTA16_YQ
YQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 171 - protein, 252 aa, Artificial sequence
  Synthetic polypeptide
  misc_feature: IgG1FcDELTA16_LQ
LQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 172 - protein, 252 aa, Artificial sequence
  Synthetic polypeptide
  misc_feature: IgG1FcDELTA16_HQ
HQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 173 - protein, 252 aa, Artificial sequence
  Synthetic polypeptide
  misc_feature: IgG1FcDELTA16_QQ
QQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 174 - protein, 252 aa, Artificial sequence
  Synthetic polypeptide
  misc_feature: IgG1FcDELTA16_IQ
IQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 175 - protein, 252 aa, Artificial sequence
  Synthetic polypeptide
  misc_feature: IgG1FcDELTA16_MQ
MQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 176 - protein, 252 aa, Artificial sequence
  Synthetic polypeptide
  misc_feature: IgG1FcDELTA16_NQ
NQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 177 - protein, 252 aa, Artificial sequence
  Synthetic polypeptide
  misc_feature: IgG1FcDELTA16_KQ
KQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 178 - protein, 252 aa, Artificial sequence
  Synthetic polypeptide
  misc_feature: IgG1FcDELTA16_VQ
VQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 179 - protein, 252 aa, Artificial sequence
  Synthetic polypeptide
  misc_feature: IgG1FcDELTA16_EQ
EQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 180 - protein, 252 aa, Artificial sequence
  Synthetic polypeptide
  misc_feature: IgG1FcDELTA16_DQ
DQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 181 - protein, 252 aa, Artificial sequence
  Synthetic polypeptide
  misc_feature: IgG1FcDELTA16_CQ
CQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 182 - protein, 252 aa, Artificial sequence
  Synthetic polypeptide
  misc_feature: IgG1FcDELTA16_WQ
WQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 183 - protein, 252 aa, Artificial sequence
  Synthetic polypeptide
  misc_feature: IgG1FcDELTA16_PQ
PQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 184 - protein, 252 aa, Artificial sequence
  Synthetic polypeptide
  misc_feature: IgG1FcDELTA16_RQ
RQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 185 - protein, 252 aa, Artificial sequence
  Synthetic polypeptide
  misc_feature: IgG1FcDELTA16_TQ
TQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 186 - protein, 252 aa, Artificial sequence
  Synthetic polypeptide
  misc_feature: IgG1FcDELTA16_AQ
AQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 187 - protein, 252 aa, Artificial sequence
  Synthetic polypeptide
  misc_feature: IgG1FcDELTA16_GQ
GQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPEGCPTNGPKIPSIATGMVGALLLLLVVALGIGLFMRRRHIVRKR

SEQ ID NO: 188 - protein, 470 aa, Artificial sequence
  Synthetic polypeptide
  misc_feature: Ritu-EETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 189 - protein, 470 aa, Artificial sequence
  Synthetic polypeptide
  misc_feature: Ritu-FETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPFETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 190 - protein, 470 aa, Artificial sequence
  Synthetic polypeptide
  misc_feature: Ritu-YETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPYETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 191 - protein, 470 aa, Artificial sequence
  Synthetic polypeptide
  misc_feature: Ritu-LETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPLETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 192 - protein, 470 aa, Artificial sequence
  Synthetic polypeptide
  misc_feature: Ritu-HETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPHETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 193 - protein, 470 aa, Artificial sequence
  Synthetic polypeptide
  misc_feature: Ritu-QETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPQETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 194 - protein, 470 aa, Artificial sequence
  Synthetic polypeptide
  misc_feature: Ritu-IETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPIETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 195 - protein, 470 aa, Artificial sequence
  Synthetic polypeptide
  misc_feature: Ritu-METCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPMETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - protein, 470 aa, Artificial sequence
  Synthetic polypeptide
  misc_feature: Ritu-NETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPNETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 197 - protein, 470 aa, Artificial sequence
  Synthetic polypeptide
  misc_feature: Ritu-KETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPKETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - protein, 470 aa, Artificial sequence
  Synthetic polypeptide
  misc_feature: Ritu-VETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPVETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 199 - protein, 470 aa, Artificial sequence
  Synthetic polypeptide
  misc_feature: Ritu-DETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPDETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 470 aa, Artificial sequence
  Synthetic polypeptide
  misc_feature: Ritu-SETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPSETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 201 - protein, 470 aa, Artificial sequence
  Synthetic polypeptide
  misc_feature: Ritu-CETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPCETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 470 aa, Artificial sequence
  Synthetic polypeptide
  misc_feature: Ritu-WETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPWETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - protein, 470 aa, Artificial sequence
  Synthetic polypeptide
  misc_feature: Ritu-PETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 470 aa, Artificial sequence
  Synthetic polypeptide
  misc_feature: Ritu-RETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPRETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 470 aa, Artificial sequence
  Synthetic polypeptide
  misc_feature: Ritu-TETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPTETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 470 aa, Artificial sequence
  Synthetic polypeptide
  misc_feature: Ritu-AETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPAETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - protein, 470 aa, Artificial sequence
  Synthetic polypeptide
  misc_feature: Ritu-GETCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPGETCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 208 - protein, 470 aa, Artificial sequence
  Synthetic polypeptide
  misc_feature: Ritu-EFTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 209 - protein, 470 aa, Artificial sequence
  Synthetic polypeptide
  misc_feature: Ritu-EYTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 210 - protein, 470 aa, Artificial sequence
  Synthetic polypeptide
  misc_feature: Ritu-ELTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 211 - protein, 470 aa, Artificial sequence
  Synthetic polypeptide
  misc_feature: Ritu-EHTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEHTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - protein, 470 aa, Artificial sequence
  Synthetic polypeptide
  misc_feature: Ritu-EQTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEQTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 213 - protein, 470 aa, Artificial sequence
  Synthetic polypeptide
  misc_feature: Ritu-EITCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEITCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 470 aa, Artificial sequence
  Synthetic polypeptide
  misc_feature: Ritu-EMTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEMTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 215 - protein, 470 aa, Artificial sequence
  Synthetic polypeptide
  misc_feature: Ritu-ENTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPENTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 216 - protein, 470 aa, Artificial sequence
  Synthetic polypeptide
  misc_feature: Ritu-EKTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEKTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 217 - protein, 470 aa, Artificial sequence
  Synthetic polypeptide
  misc_feature: Ritu-EVTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEVTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - protein, 470 aa, Artificial sequence
  Synthetic polypeptide
  misc_feature: Ritu-EDTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEDTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 219 - protein, 470 aa, Artificial sequence
  Synthetic polypeptide
  misc_feature: Ritu-ESTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPESTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 470 aa, Artificial sequence
  Synthetic polypeptide
  misc_feature: Ritu-ECTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPECTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - protein, 470 aa, Artificial sequence
  Synthetic polypeptide
  misc_feature: Ritu-EWTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEWTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - protein, 470 aa, Artificial sequence
  Synthetic polypeptide
  misc_feature: Ritu-EPTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEPTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 223 - protein, 470 aa, Artificial sequence
  Synthetic polypeptide
  misc_feature: Ritu-ERTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPERTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 224 - protein, 470 aa, Artificial sequence
  Synthetic polypeptide
  misc_feature: Ritu-ETTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPETTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 225 - protein, 470 aa, Artificial sequence
  Synthetic polypeptide
  misc_feature: Ritu-EATCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEATCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 226 - protein, 470 aa, Artificial sequence
  Synthetic polypeptide
  misc_feature: Ritu-EGTCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEGTCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 227 - protein, 470 aa, Artificial sequence
  Synthetic polypeptide
  misc_feature: Ritu-EEFCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEFCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 228 - protein, 470 aa, Artificial sequence
  Synthetic polypeptide
  misc_feature: Ritu-EEYCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEYCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 229 - protein, 470 aa, Artificial sequence
  Synthetic polypeptide
  misc_feature: Ritu-EELCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEELCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - protein, 470 aa, Artificial sequence
  Synthetic polypeptide
  misc_feature: Ritu-EEHCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEHCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 231 - protein, 470 aa, Artificial sequence
  Synthetic polypeptide
  misc_feature: Ritu-EEQCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEQCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 232 - protein, 470 aa, Artificial sequence
  Synthetic polypeptide
  misc_feature: Ritu-EEICWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEICWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - protein, 470 aa, Artificial sequence
  Synthetic polypeptide
  misc_feature: Ritu-EEMCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEMCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 234 - protein, 470 aa, Artificial sequence
  Synthetic polypeptide
  misc_feature: Ritu-EENCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEENCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 235 - protein, 470 aa, Artificial sequence
  Synthetic polypeptide
  misc_feature: Ritu-EEKCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEKCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 236 - protein, 470 aa, Artificial sequence
  Synthetic polypeptide
  misc_feature: Ritu-EEVCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEVCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 237 - protein, 470 aa, Artificial sequence
  Synthetic polypeptide
  misc_feature: Ritu-EEECWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEECWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 470 aa, Artificial sequence
  Synthetic polypeptide
  misc_feature: Ritu-EEDCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEDCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 470 aa, Artificial sequence
  Synthetic polypeptide
  misc_feature: Ritu-EESCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEESCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 470 aa, Artificial sequence
  Synthetic polypeptide
  misc_feature: Ritu-EECCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEECCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 241 - protein, 470 aa, Artificial sequence
  Synthetic polypeptide
  misc_feature: Ritu-EEWCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEWCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 470 aa, Artificial sequence
  Synthetic polypeptide
  misc_feature: Ritu-EEPCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEPCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 243 - protein, 470 aa, Artificial sequence
  Synthetic polypeptide
  misc_feature: Ritu-EERCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEERCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 244 - protein, 470 aa, Artificial sequence
  Synthetic polypeptide
  misc_feature: Ritu-EEACWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEACWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 245 - protein, 470 aa, Artificial sequence
  Synthetic polypeptide
  misc_feature: Ritu-EEGCWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEGCWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - protein, 470 aa, Artificial sequence; identical to SEQ ID NO: 188
  Synthetic polypeptide
  misc_feature: Ritu-EETFWDW

SEQ ID NO: 247 - protein, 470 aa, Artificial sequence
  Synthetic polypeptide
  misc_feature: Ritu-EETYWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETYWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 248 - protein, 470 aa, Artificial sequence
  Synthetic polypeptide
  misc_feature: Ritu-EETLWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETLWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 249 - protein, 470 aa, Artificial sequence
  Synthetic polypeptide
  misc_feature: Ritu-EETHWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETHWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 250 - protein, 470 aa, Artificial sequence
  Synthetic polypeptide
  misc_feature: Ritu-EETQWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETQWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 251 - protein, 470 aa, Artificial sequence
  Synthetic polypeptide
  misc_feature: Ritu-EETIWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETIWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 252 - protein, 470 aa, Artificial sequence
  Synthetic polypeptide
  misc_feature: Ritu-EETMWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETMWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 253 - protein, 470 aa, Artificial sequence
  Synthetic polypeptide
  misc_feature: Ritu-EETNWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETNWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - protein, 470 aa, Artificial sequence
  Synthetic polypeptide
  misc_feature: Ritu-EETKWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETKWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 255 - protein, 470 aa, Artificial sequence
  Synthetic polypeptide
  misc_feature: Ritu-EETVWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETVWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - protein, 470 aa, Artificial sequence
  Synthetic polypeptide
  misc_feature: Ritu-EETEWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETEWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 257 - protein, 470 aa, Artificial sequence
  Synthetic polypeptide
  misc_feature: Ritu-EETDWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETDWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - protein, 470 aa, Artificial sequence
  Synthetic polypeptide
  misc_feature: Ritu-EETSWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETSWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 259 - protein, 470 aa, Artificial sequence
  Synthetic polypeptide
  misc_feature: Ritu-EETWWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETWWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 260 - protein, 470 aa, Artificial sequence
  Synthetic polypeptide
  misc_feature: Ritu-EETPWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETPWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 261 - protein, 470 aa, Artificial sequence
  Synthetic polypeptide
  misc_feature: Ritu-EETRWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETRWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 262 - protein, 470 aa, Artificial sequence
  Synthetic polypeptide
  misc_feature: Ritu-EETTWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETTWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 263 - protein, 470 aa, Artificial sequence
  Synthetic polypeptide
  misc_feature: Ritu-EETAWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETAWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 264 - protein, 470 aa, Artificial sequence
  Synthetic polypeptide
  misc_feature: Ritu-EETGWDW
MDWTWRILFLVAAATGAHSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEETGWDWVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 265 - protein, 470 aa, Artificial sequence; identical to SEQ ID NO: 188
  Synthetic polypeptide
  misc_feature: Ritu-EETCWDD

SEQ ID NO: 266 - protein, 470 aa, Artificial sequence; identical to SEQ ID NO: 250
  Synthetic polypeptide
  misc_feature: Ritu-EETQWDD

SEQ ID NO: 267 - DNA, 19 bp, Artificial sequence
  Synthetic polynucleotide
  misc_feature: IgG1FcDELTA16 common reverse primer
gggccgagcggcgtggagc

SEQ ID NO: 268 - DNA, 27 bp, Artificial sequence
  Synthetic polynucleotide
  misc_feature: IgG1FcDELTA16_S forward primer
tcagtcttcctcttccccccaaaaccc

SEQ ID NO: 269 - DNA, 27 bp, Artificial sequence
  Synthetic polynucleotide
  misc_feature: IgG1FcDELTA16_F forward primer
tttgtcttcctcttccccccaaaaccc

SEQ ID NO: 270 - DNA, 27 bp, Artificial sequence
  Synthetic polynucleotide
  misc_feature: IgG1FcDELTA16_Y forward primer
tatgtcttcctcttccccccaaaaccc

SEQ ID NO: 271 - DNA, 27 bp, Artificial sequence
  Synthetic polynucleotide
  misc_feature: IgG1FcDELTA16_L forward primer
ctggtcttcctcttccccccaaaaccc

SEQ ID NO: 272 - DNA, 27 bp, Artificial sequence
  Synthetic polynucleotide
  misc_feature: IgG1FcDELTA16_H forward primer
catgtcttcctcttccccccaaaaccc

SEQ ID NO: 273 - DNA, 27 bp, Artificial sequence
  Synthetic polynucleotide
  misc_feature: IgG1FcDELTA16_Q forward primer
caggtcttcctcttccccccaaaaccc

SEQ ID NO: 274 - DNA, 27 bp, Artificial sequence
  Synthetic polynucleotide
  misc_feature: IgG1FcDELTA16_I forward primer
attgtcttcctcttccccccaaaaccc

SEQ ID NO: 275 - DNA, 27 bp, Artificial sequence
  Synthetic polynucleotide
  misc_feature: IgG1FcDELTA16_M forward primer
atggtcttcctcttccccccaaaaccc

SEQ ID NO: 276 - DNA, 27 bp, Artificial sequence
  Synthetic polynucleotide
  misc_feature: IgG1FcDELTA16_N forward primer
aacgtcttcctcttccccccaaaaccc

SEQ ID NO: 277 - DNA, 27 bp, Artificial sequence
  Synthetic polynucleotide
  misc_feature: IgG1FcDELTA16_K forward primer
aaagtcttcctcttccccccaaaaccc

SEQ ID NO: 278 - DNA, 27 bp, Artificial sequence
  Synthetic polynucleotide
  misc_feature: IgG1FcDELTA16_V forward primer
gtggtcttcctcttccccccaaaaccc

SEQ ID NO: 279 - DNA, 27 bp, Artificial sequence
  Synthetic polynucleotide
  misc_feature: IgG1FcDELTA16_E forward primer
gaagtcttcctcttccccccaaaaccc

SEQ ID NO: 280 - DNA, 27 bp, Artificial sequence
  Synthetic polynucleotide
  misc_feature: IgG1FcDELTA16_D forward primer
gatgtcttcctcttccccccaaaaccc

SEQ ID NO: 281 - DNA, 27 bp, Artificial sequence
  Synthetic polynucleotide
  misc_feature: IgG1FcDELTA16_C forward primer
tgcgtcttcctcttccccccaaaaccc

SEQ ID NO: 282 - DNA, 27 bp, Artificial sequence
  Synthetic polynucleotide
  misc_feature: IgG1FcDELTA16_W forward primer
tgggtcttcctcttccccccaaaaccc

SEQ ID NO: 283 - DNA, 27 bp, Artificial sequence
  Synthetic polynucleotide
  misc_feature: IgG1FcDELTA16_P forward primer
ccggtcttcctcttccccccaaaaccc

SEQ ID NO: 284 - DNA, 27 bp, Artificial sequence
  Synthetic polynucleotide
  misc_feature: IgG1FcDELTA16_R forward primer
cgtgtcttcctcttccccccaaaaccc

SEQ ID NO: 285 - DNA, 27 bp, Artificial sequence
  Synthetic polynucleotide
  misc_feature: IgG1FcDELTA16_T forward primer
accgtcttcctcttccccccaaaaccc

SEQ ID NO: 286 - DNA, 27 bp, Artificial sequence
  Synthetic polynucleotide
  misc_feature: IgG1FcDELTA16_A forward primer
gcggtcttcctcttccccccaaaaccc

SEQ ID NO: 287 - DNA, 27 bp, Artificial sequence
  Synthetic polynucleotide
  misc_feature: IgG1FcDELTA16_G forward primer
ggcgtcttcctcttccccccaaaaccc

SEQ ID NO: 288 - DNA, 30 bp, Artificial sequence
  Synthetic polynucleotide
  misc_feature: IgG1FcDELTA16_SS
tcaagcgtcttcctcttccccccaaaaccc

SEQ ID NO: 289 - DNA, 30 bp, Artificial sequence
  Synthetic polynucleotide
  misc_feature: IgG1FcDELTA16_FS forward primer
tttagcgtcttcctcttccccccaaaaccc

SEQ ID NO: 290 - DNA, 30 bp, Artificial sequence
  Synthetic polynucleotide
  misc_feature: IgG1FcDELTA16_YS forward primer
tatagcgtcttcctcttccccccaaaaccc

SEQ ID NO: 291 - DNA, 30 bp, Artificial sequence
  Synthetic polynucleotide
  misc_feature: IgG1FcDELTA16_LS forward primer
ctgagcgtcttcctcttccccccaaaaccc

SEQ ID NO: 292 - DNA, 30 bp, Artificial sequence
  Synthetic polynucleotide
  misc_feature: IgG1FcDELTA16_HS forward primer
catagcgtcttcctcttccccccaaaaccc

SEQ ID NO: 293 - DNA, 30 bp, Artificial sequence
  Synthetic polynucleotide
  misc_feature: IgG1FcDELTA16_QS forward primer
cagagcgtcttcctcttccccccaaaaccc

SEQ ID NO: 294 - DNA, 30 bp, Artificial sequence
  Synthetic polynucleotide
  misc_feature: IgG1FcDELTA16_IS forward primer
attagcgtcttcctcttccccccaaaaccc

SEQ ID NO: 295 - DNA, 30 bp, Artificial sequence
  Synthetic polynucleotide
  misc_feature: IgG1FcDELTA16_MS forward primer
atgagcgtcttcctcttccccccaaaaccc

SEQ ID NO: 296 - DNA, 30 bp, Artificial sequence
  Synthetic polynucleotide
  misc_feature: IgG1FcDELTA16_NS forward primer
aacagcgtcttcctcttccccccaaaaccc

SEQ ID NO: 297 - DNA, 30 bp, Artificial sequence
  Synthetic polynucleotide
  misc_feature: IgG1FcDELTA16_KS forward primer
aaaagcgtcttcctcttccccccaaaaccc

SEQ ID NO: 298 - DNA, 30 bp, Artificial sequence
  Synthetic polynucleotide
  misc_feature: IgG1FcDELTA16_VS forward primer
gtgagcgtcttcctcttccccccaaaaccc

SEQ ID NO: 299 - DNA, 30 bp, Artificial sequence
  Synthetic polynucleotide
  misc_feature: IgG1FcDELTA16_ES forward primer
gaaagcgtcttcctcttccccccaaaaccc

SEQ ID NO: 300 - DNA, 30 bp, Artificial sequence
  Synthetic polynucleotide
  misc_feature: IgG1FcDELTA16_DS
gatagcgtcttcctcttccccccaaaaccc

SEQ ID NO: 301 - DNA, 30 bp, Artificial sequence
  Synthetic polynucleotide
  misc_feature: IgG1FcDELTA16_CS forward primer
tgcagcgtcttcctcttccccccaaaaccc

SEQ ID NO: 302 - DNA, 30 bp, Artificial sequence
  Synthetic polynucleotide
  misc_feature: IgG1FcDELTA16_WS forward primer
tggagcgtcttcctcttccccccaaaaccc

SEQ ID NO: 303 - DNA, 30 bp, Artificial sequence
  Synthetic polynucleotide
  misc_feature: IgG1FcDELTA16_PS forward primer
ccgagcgtcttcctcttccccccaaaaccc

SEQ ID NO: 304 - DNA, 30 bp, Artificial sequence
  Synthetic polynucleotide
  misc_feature: IgG1FcDELTA16_RS forward primer
cgtagcgtcttcctcttccccccaaaaccc

SEQ ID NO: 305 - DNA, 30 bp, Artificial sequence
  Synthetic polynucleotide
  misc_feature: IgG1FcDELTA16_TS forward primer
accagcgtcttcctcttccccccaaaaccc

SEQ ID NO: 306 - DNA, 30 bp, Artificial sequence
  Synthetic polynucleotide
  misc_feature: IgG1FcDELTA16_AS forward primer
gcgagcgtcttcctcttccccccaaaaccc

SEQ ID NO: 307 - DNA, 30 bp, Artificial sequence
  Synthetic polynucleotide
  misc_feature: IgG1FcDELTA16_GS forward primer
ggcagcgtcttcctcttccccccaaaaccc

SEQ ID NO: 308 - DNA, 30 bp, Artificial sequence
  Synthetic polynucleotide
  misc_feature: IgG1FcDELTA16_xx  forward primer
  misc_feature (1)..(2): N is any nucleotide
  misc_feature (3)..(3): K is G or T
  misc_feature (4)..(5): N is any nucleotide
  misc_feature (6)..(6): K is G or T
nnknnkgtcttcctcttccccccaaaaccc

SEQ ID NO: 309 - DNA, 33 bp, Artificial sequence
  Synthetic polynucleotide
  misc_feature: IgG1FcDELTA16_xxX forward primer
  misc_feature (1)..(2): N is any nucleotide
  misc_feature (3)..(3): K is G or T
  misc_feature (4)..(5): N is any nucleotide
  misc_feature (6)..(6): K is G or T
  misc_feature (7)..(8): N is any nucleotide
  misc_feature (9)..(9): K is G or T
nnknnknnkgtcttcctcttccccccaaaaccc

SEQ ID NO: 310 - DNA, 45 bp, Artificial sequence
  Synthetic polynucleotide
  misc_feature: IgG1FcDELTA16_ELLGGPS forward primer
gaactcctgggaggaccgtcagtcttcctcttccccccaaaaccc

SEQ ID NO: 311 - DNA, 42 bp, Artificial sequence
  Synthetic polynucleotide
  misc_feature: IgG1FcDELTA16_LLGGPS forward primer
ctcctgggaggaccgtcagtcttcctcttccccccaaaaccc

SEQ ID NO: 312 - DNA, 39 bp, Artificial sequence
  Synthetic polynucleotide
  misc_feature: IgG1FcDELTA16_LGGPS forward primer
ctgggaggaccgtcagtcttcctcttccccccaaaaccc

SEQ ID NO: 313 - DNA, 36 bp, Artificial sequence
  Synthetic polynucleotide
  misc_feature: IgG1FcDELTA16_GGPS forward primer
ggaggaccgtcagtcttcctcttccccccaaaaccc

SEQ ID NO: 314 - DNA, 33 bp, Artificial sequence
  Synthetic polynucleotide
  misc_feature: IgG1FcDELTA16_GPS forward primer
ggaccgtcagtcttcctcttccccccaaaaccc

SEQ ID NO: 315 - DNA, 33 bp, Artificial sequence
  Synthetic polynucleotide
  misc_feature: IgG1FcDELTA16_SDW forward primer
tcagattgggtcttcctcttccccccaaaaccc

SEQ ID NO: 316 - DNA, 33 bp, Artificial sequence
  Synthetic polynucleotide
  misc_feature: IgG1FcDELTA16_FDW forward primer
tttgattgggtcttcctcttccccccaaaaccc

SEQ ID NO: 317 - DNA, 33 bp, Artificial sequence
  Synthetic polynucleotide
  misc_feature: IgG1FcDELTA16_YDW forward primer
tatgattgggtcttcctcttccccccaaaaccc

SEQ ID NO: 318 - DNA, 33 bp, Artificial sequence
  Synthetic polynucleotide
  misc_feature: IgG1FcDELTA16_LDW forward primer
ctggattgggtcttcctcttccccccaaaaccc

SEQ ID NO: 319 - DNA, 33 bp, Artificial sequence
  Synthetic polynucleotide
  misc_feature: IgG1FcDELTA16_HDW forward primer
catgattgggtcttcctcttccccccaaaaccc

SEQ ID NO: 320 - DNA, 33 bp, Artificial sequence
  Synthetic polynucleotide
  misc_feature: IgG1FcDELTA16_QDW forward primer
caggattgggtcttcctcttccccccaaaaccc

SEQ ID NO: 321 - DNA, 33 bp, Artificial sequence
  Synthetic polynucleotide
  misc_feature: IgG1FcDELTA16_IDW forward primer
attgattgggtcttcctcttccccccaaaaccc

SEQ ID NO: 322 - DNA, 33 bp, Artificial sequence
  Synthetic polynucleotide
  misc_feature: IgG1FcDELTA16_MDW forward primer
atggattgggtcttcctcttccccccaaaaccc

SEQ ID NO: 323 - DNA, 33 bp, Artificial sequence
  Synthetic polynucleotide
  misc_feature: IgG1FcDELTA16_NDW forward primer
aacgattgggtcttcctcttccccccaaaaccc

SEQ ID NO: 324 - DNA, 33 bp, Artificial sequence
  Synthetic polynucleotide
  misc_feature: IgG1FcDELTA16_KDW forward primer
aaagattgggtcttcctcttccccccaaaaccc

SEQ ID NO: 325 - DNA, 33 bp, Artificial sequence
  Synthetic polynucleotide
  misc_feature: IgG1FcDELTA16_VDW forward primer
gtggattgggtcttcctcttccccccaaaaccc

SEQ ID NO: 326 - DNA, 33 bp, Artificial sequence
  Synthetic polynucleotide
  misc_feature: IgG1FcDELTA16_EDW forward primer
gaagattgggtcttcctcttccccccaaaaccc

SEQ ID NO: 327 - DNA, 33 bp, Artificial sequence
  Synthetic polynucleotide
  misc_feature: IgG1FcDELTA16_DDW forward primer
gatgattgggtcttcctcttccccccaaaaccc

SEQ ID NO: 328 - DNA, 33 bp, Artificial sequence
  Synthetic polynucleotide
  misc_feature: IgG1FcDELTA16_CDW forward primer
tgcgattgggtcttcctcttccccccaaaaccc

SEQ ID NO: 329 - DNA, 33 bp, Artificial sequence
  Synthetic polynucleotide
  misc_feature: IgG1FcDELTA16_WDW forward primer
tgggattgggtcttcctcttccccccaaaaccc

SEQ ID NO: 330 - DNA, 33 bp, Artificial sequence
  Synthetic polynucleotide
  misc_feature: IgG1FcDELTA16_PDW forward primer
ccggattgggtcttcctcttccccccaaaaccc

SEQ ID NO: 331 - DNA, 33 bp, Artificial sequence
  Synthetic polynucleotide
  misc_feature: IgG1FcDELTA16_RDW forward primer
cgtgattgggtcttcctcttccccccaaaaccc

SEQ ID NO: 332 - DNA, 33 bp, Artificial sequence
  Synthetic polynucleotide
  misc_feature: IgG1FcDELTA16_TDW forward primer
accgattgggtcttcctcttccccccaaaaccc

SEQ ID NO: 333 - DNA, 33 bp, Artificial sequence
  Synthetic polynucleotide
  misc_feature: IgG1FcDELTA16_ADW forward primer
gcggattgggtcttcctcttccccccaaaaccc

SEQ ID NO: 334 - DNA, 33 bp, Artificial sequence
  Synthetic polynucleotide
  misc_feature: IgG1FcDELTA16_GDW forward primer
ggcgattgggtcttcctcttccccccaaaaccc

SEQ ID NO: 335 - DNA, 39 bp, Artificial sequence
  Synthetic polynucleotide
  misc_feature: IgG1FcDELTA16_SCWDW forward primer
tcatgttgggattgggtcttcctcttccccccaaaaccc

SEQ ID NO: 336 - DNA, 39 bp, Artificial sequence
  Synthetic polynucleotide
  misc_feature: IgG1FcDELTA16_FCWDW forward primer
ttttgttgggattgggtcttcctcttccccccaaaaccc

SEQ ID NO: 337 - DNA, 39 bp, Artificial sequence
  Synthetic polynucleotide
  misc_feature: IgG1FcDELTA16_YCWDW forward primer
tattgttgggattgggtcttcctcttccccccaaaaccc

SEQ ID NO: 338 - DNA, 39 bp, Artificial sequence
  Synthetic polynucleotide
  misc_feature: IgG1FcDELTA16_LCWDW forward primer
ctgtgttgggattgggtcttcctcttccccccaaaaccc

SEQ ID NO: 339 - DNA, 39 bp, Artificial sequence
  Synthetic polynucleotide
  misc_feature: IgG1FcDELTA16_HCWDW forward primer
cattgttgggattgggtcttcctcttccccccaaaaccc

SEQ ID NO: 340 - DNA, 39 bp, Artificial sequence
  Synthetic polynucleotide
  misc_feature: IgG1FcDELTA16_QCWDW forward primer
cagtgttgggattgggtcttcctcttccccccaaaaccc

SEQ ID NO: 341 - DNA, 39 bp, Artificial sequence
  Synthetic polynucleotide
  misc_feature: IgG1FcDELTA16_ICWDW forward primer
atttgttgggattgggtcttcctcttccccccaaaaccc

SEQ ID NO: 342 - DNA, 39 bp, Artificial sequence
  Synthetic polynucleotide
  misc_feature: IgG1FcDELTA16_MCWDW forward primer
atgtgttgggattgggtcttcctcttccccccaaaaccc

SEQ ID NO: 343 - DNA, 39 bp, Artificial sequence
  Synthetic polynucleotide
  misc_feature: IgG1FcDELTA16_NCWDW forward primer
aactgttgggattgggtcttcctcttccccccaaaaccc

SEQ ID NO: 344 - DNA, 39 bp, Artificial sequence
  Synthetic polynucleotide
  misc_feature: IgG1FcDELTA16_KCWDW forward primer
aaatgttgggattgggtcttcctcttccccccaaaaccc

SEQ ID NO: 345 - DNA, 39 bp, Artificial sequence
  Synthetic polynucleotide
  misc_feature: IgG1FcDELTA16_VCWDW forward primer
gtgtgttgggattgggtcttcctcttccccccaaaaccc

SEQ ID NO: 346 - DNA, 39 bp, Artificial sequence
  Synthetic polynucleotide
  misc_feature: IgG1FcDELTA16_ECWDW forward primer
gaatgttgggattgggtcttcctcttccccccaaaaccc

SEQ ID NO: 347 - DNA, 39 bp, Artificial sequence
  Synthetic polynucleotide
  misc_feature: IgG1FcDELTA16_DCWDW forward primer
gattgttgggattgggtcttcctcttccccccaaaaccc

SEQ ID NO: 348 - DNA, 39 bp, Artificial sequence
  Synthetic polynucleotide
  misc_feature: IgG1FcDELTA16_CCWDW forward primer
tgctgttgggattgggtcttcctcttccccccaaaaccc

SEQ ID NO: 349 - DNA, 39 bp, Artificial sequence
  Synthetic polynucleotide
  misc_feature: IgG1FcDELTA16_WCWDW forward primer
tggtgttgggattgggtcttcctcttccccccaaaaccc

SEQ ID NO: 350 - DNA, 39 bp, Artificial sequence
  Synthetic polynucleotide
  misc_feature: IgG1FcDELTA16_PCWDW forward primer
ccgtgttgggattgggtcttcctcttccccccaaaaccc

SEQ ID NO: 351 - DNA, 39 bp, Artificial sequence
  Synthetic polynucleotide
  misc_feature: IgG1FcDELTA16_RCWDW forward primer
cgttgttgggattgggtcttcctcttccccccaaaaccc

SEQ ID NO: 352 - DNA, 39 bp, Artificial sequence
  Synthetic polynucleotide
  misc_feature: IgG1FcDELTA16_TCWDW forward primer
acctgttgggattgggtcttcctcttccccccaaaaccc

SEQ ID NO: 353 - DNA, 39 bp, Artificial sequence
  Synthetic polynucleotide
  misc_feature: IgG1FcDELTA16_ACWDW forward primer
gcgtgttgggattgggtcttcctcttccccccaaaaccc

SEQ ID NO: 354 - DNA, 39 bp, Artificial sequence
  Synthetic polynucleotide
  misc_feature: IgG1FcDELTA16_GCWDW forward primer
ggctgttgggattgggtcttcctcttccccccaaaaccc

SEQ ID NO: 355 - DNA, 42 bp, Artificial sequence
  Synthetic polynucleotide
  misc_feature: IgG1FcDELTA16_XXCWDW forward primer
  misc_feature (1)..(2): N is any nucleotide
  misc_feature (3)..(3): K is G or T
  misc_feature (4)..(5): N is any nucleotide
  misc_feature (6)..(6): K is G or T
nnknnktgttgggattgggtcttcctcttccccccaaaaccc

SEQ ID NO: 356 - DNA, 21 bp, Artificial sequence
  Synthetic polynucleotide
  misc_feature: IgG1FcDELTA16 common forward primer
gtcttcctcttccccccaaaa

SEQ ID NO: 357 - DNA, 25 bp, Artificial sequence
  Synthetic polynucleotide
  misc_feature: IgG1FcDELTA16_SD reverse primer
atcgctgggccgagcggcgtggagc

SEQ ID NO: 358 - DNA, 25 bp, Artificial sequence
  Synthetic polynucleotide
  misc_feature: IgG1FcDELTA16_FD reverse primer
atcaaagggccgagcggcgtggagc

SEQ ID NO: 359 - DNA, 25 bp, Artificial sequence
  Synthetic polynucleotide
  misc_feature: IgG1FcDELTA16_YD reverse primer
atcatagggccgagcggcgtggagc

SEQ ID NO: 360 - DNA, 25 bp, Artificial sequence
  Synthetic polynucleotide
  misc_feature: IgG1FcDELTA16_LD reverse primer
atccaggggccgagcggcgtggagc

SEQ ID NO: 361 - DNA, 25 bp, Artificial sequence
  Synthetic polynucleotide
  misc_feature: IgG1FcDELTA16_HD reverse primer
atcatggggccgagcggcgtggagc

SEQ ID NO: 362 - DNA, 25 bp, Artificial sequence
  Synthetic polynucleotide
  misc_feature: IgG1FcDELTA16_QD reverse primer
atcctggggccgagcggcgtggagc

SEQ ID NO: 363 - DNA, 25 bp, Artificial sequence
  Synthetic polynucleotide
  misc_feature: IgG1FcDELTA16_ID reverse primer
atcaatgggccgagcggcgtggagc

SEQ ID NO: 364 - DNA, 25 bp, Artificial sequence
  Synthetic polynucleotide
  misc_feature: IgG1FcDELTA16_MD reverse primer
atccatgggccgagcggcgtggagc

SEQ ID NO: 365 - DNA, 25 bp, Artificial sequence
  Synthetic polynucleotide
  misc_feature: IgG1FcDELTA16_ND reverse primer
atcgttgggccgagcggcgtggagc

SEQ ID NO: 366 - DNA, 25 bp, Artificial sequence
  Synthetic polynucleotide
  misc_feature: IgG1FcDELTA16_KD reverse primer
atctttgggccgagcggcgtggagc

SEQ ID NO: 367 - DNA, 25 bp, Artificial sequence
  Synthetic polynucleotide
  misc_feature: IgG1FcDELTA16_VD reverse primer
atccacgggccgagcggcgtggagc

SEQ ID NO: 368 - DNA, 25 bp, Artificial sequence
  Synthetic polynucleotide
  misc_feature: IgG1FcDELTA16_ED reverse primer
atcttcgggccgagcggcgtggagc

SEQ ID NO: 369 - DNA, 25 bp, Artificial sequence
  Synthetic polynucleotide
  misc_feature: IgG1FcDELTA16_DD reverse primer
atcatcgggccgagcggcgtggagc

SEQ ID NO: 370 - DNA, 25 bp, Artificial sequence
  Synthetic polynucleotide
  misc_feature: IgG1FcDELTA16_CD reverse primer
atcgcagggccgagcggcgtggagc

SEQ ID NO: 371 - DNA, 25 bp, Artificial sequence
  Synthetic polynucleotide
  misc_feature: IgG1FcDELTA16_WD reverse primer
atcccagggccgagcggcgtggagc

SEQ ID NO: 372 - DNA, 25 bp, Artificial sequence
  Synthetic polynucleotide
  misc_feature: IgG1FcDELTA16_PD reverse primer
atccgggggccgagcggcgtggagc

SEQ ID NO: 373 - DNA, 25 bp, Artificial sequence
  Synthetic polynucleotide
  misc_feature: IgG1FcDELTA16_RD reverse primer
atcacggggccgagcggcgtggagc

SEQ ID NO: 374 - DNA, 25 bp, Artificial sequence
  Synthetic polynucleotide
  misc_feature: IgG1FcDELTA16_TD reverse primer
atcggtgggccgagcggcgtggagc

SEQ ID NO: 375 - DNA, 25 bp, Artificial sequence
  Synthetic polynucleotide
  misc_feature: IgG1FcDELTA16_AD reverse primer
atccgcgggccgagcggcgtggagc

SEQ ID NO: 376 - DNA, 25 bp, Artificial sequence
  Synthetic polynucleotide
  misc_feature: IgG1FcDELTA16_GD reverse primer
atcgccgggccgagcggcgtggagc

SEQ ID NO: 377 - DNA, 25 bp, Artificial sequence
  Synthetic polynucleotide
  misc_feature: IgG1FcDELTA16_SW reverse primer
ccagctgggccgagcggcgtggagc

SEQ ID NO: 378 - DNA, 25 bp, Artificial sequence
  Synthetic polynucleotide
  misc_feature: IgG1FcDELTA16_FW reverse primer
ccaaaagggccgagcggcgtggagc

SEQ ID NO: 379 - DNA, 25 bp, Artificial sequence
  Synthetic polynucleotide
  misc_feature: IgG1FcDELTA16_YW reverse primer
ccaatagggccgagcggcgtggagc

SEQ ID NO: 380 - DNA, 25 bp, Artificial sequence
  Synthetic polynucleotide
  misc_feature: IgG1FcDELTA16_LW reverse primer
ccacaggggccgagcggcgtggagc

SEQ ID NO: 381 - DNA, 25 bp, Artificial sequence
  Synthetic polynucleotide
  misc_feature: IgG1FcDELTA16_HW reverse primer
ccaatggggccgagcggcgtggagc

SEQ ID NO: 382 - DNA, 25 bp, Artificial sequence
  Synthetic polynucleotide
  misc_feature: IgG1FcDELTA16_QW reverse primer
ccactggggccgagcggcgtggagc

SEQ ID NO: 383 - DNA, 25 bp, Artificial sequence
  Synthetic polynucleotide
  misc_feature: IgG1FcDELTA16_IW reverse primer
ccaaatgggccgagcggcgtggagc

SEQ ID NO: 384 - DNA, 25 bp, Artificial sequence
  Synthetic polynucleotide
  misc_feature: IgG1FcDELTA16_MW reverse primer
ccacatgggccgagcggcgtggagc

SEQ ID NO: 385 - DNA, 25 bp, Artificial sequence
  Synthetic polynucleotide
  misc_feature: IgG1FcDELTA16_NW reverse primer
ccagttgggccgagcggcgtggagc

SEQ ID NO: 386 - DNA, 25 bp, Artificial sequence
  Synthetic polynucleotide
  misc_feature: IgG1FcDELTA16_KW reverse primer
ccatttgggccgagcggcgtggagc

SEQ ID NO: 387 - DNA, 25 bp, Artificial sequence
  Synthetic polynucleotide
  misc_feature: IgG1FcDELTA16_VW reverse primer
ccacacgggccgagcggcgtggagc

SEQ ID NO: 388 - DNA, 25 bp, Artificial sequence
  Synthetic polynucleotide
  misc_feature: IgG1FcDELTA16_EW reverse primer
ccattcgggccgagcggcgtggagc

SEQ ID NO: 389 - DNA, 25 bp, Artificial sequence
  Synthetic polynucleotide
  misc_feature: IgG1FcDELTA16_DW reverse primer
ccaatcgggccgagcggcgtggagc

SEQ ID NO: 390 - DNA, 25 bp, Artificial sequence
  Synthetic polynucleotide
  misc_feature: IgG1FcDELTA16_CW reverse primer
ccagcagggccgagcggcgtggagc

SEQ ID NO: 391 - DNA, 25 bp, Artificial sequence
  Synthetic polynucleotide
  misc_feature: IgG1FcDELTA16_WW reverse primer
ccaccagggccgagcggcgtggagc

SEQ ID NO: 392 - DNA, 25 bp, Artificial sequence
  Synthetic polynucleotide
  misc_feature: IgG1FcDELTA16_PW reverse primer
ccacgggggccgagcggcgtggagc

SEQ ID NO: 393 - DNA, 25 bp, Artificial sequence
  Synthetic polynucleotide
  misc_feature: IgG1FcDELTA16_RW reverse primer
ccaacggggccgagcggcgtggagc

SEQ ID NO: 394 - DNA, 25 bp, Artificial sequence
  Synthetic polynucleotide
  misc_feature: IgG1FcDELTA16_TW reverse primer
ccaggtgggccgagcggcgtggagc

SEQ ID NO: 395 - DNA, 25 bp, Artificial sequence
  Synthetic polynucleotide
  misc_feature: IgG1FcDELTA16_AW reverse primer
ccacgcgggccgagcggcgtggagc

SEQ ID NO: 396 - DNA, 25 bp, Artificial sequence
  Synthetic polynucleotide
  misc_feature: IgG1FcDELTA16_GW reverse primer
ccagccgggccgagcggcgtggagc

SEQ ID NO: 397 - DNA, 25 bp, Artificial sequence
  Synthetic polynucleotide
  misc_feature: IgG1FcDELTA16_SE reverse primer
ttcgctgggccgagcggcgtggagc

SEQ ID NO: 398 - DNA, 25 bp, Artificial sequence
  Synthetic polynucleotide
  misc_feature: IgG1FcDELTA16_FE reverse primer
ttcaaagggccgagcggcgtggagc

SEQ ID NO: 399 - DNA, 25 bp, Artificial sequence
  Synthetic polynucleotide
  misc_feature: IgG1FcDELTA16_YE reverse primer
ttcatagggccgagcggcgtggagc

SEQ ID NO: 400 - DNA, 25 bp, Artificial sequence
  Synthetic polynucleotide
  misc_feature: IgG1FcDELTA16_LE reverse primer
ttccaggggccgagcggcgtggagc

SEQ ID NO: 401 - DNA, 25 bp, Artificial sequence
  Synthetic polynucleotide
  misc_feature: IgG1FcDELTA16_HE reverse primer
ttcatggggccgagcggcgtggagc

SEQ ID NO: 402 - DNA, 25 bp, Artificial sequence
  Synthetic polynucleotide
  misc_feature: IgG1FcDELTA16_QE reverse primer
ttcctggggccgagcggcgtggagc

SEQ ID NO: 403 - DNA, 25 bp, Artificial sequence
  Synthetic polynucleotide
  misc_feature: IgG1FcDELTA16_IE reverse primer
ttcaatgggccgagcggcgtggagc

SEQ ID NO: 404 - DNA, 25 bp, Artificial sequence
  Synthetic polynucleotide
  misc_feature: IgG1FcDELTA16_ME reverse primer
ttccatgggccgagcggcgtggagc

SEQ ID NO: 405 - DNA, 25 bp, Artificial sequence
  Synthetic polynucleotide
  misc_feature: IgG1FcDELTA16_NE reverse primer
ttcgttgggccgagcggcgtggagc

SEQ ID NO: 406 - DNA, 25 bp, Artificial sequence
  Synthetic polynucleotide
  misc_feature: IgG1FcDELTA16_KE reverse primer
ttctttgggccgagcggcgtggagc

SEQ ID NO: 407 - DNA, 25 bp, Artificial sequence
  Synthetic polynucleotide
  misc_feature: IgG1FcDELTA16_VE reverse primer
ttccacgggccgagcggcgtggagc

SEQ ID NO: 408 - DNA, 25 bp, Artificial sequence
  Synthetic polynucleotide
  misc_feature: IgG1FcDELTA16_EE reverse primer
ttcttcgggccgagcggcgtggagc

SEQ ID NO: 409 - DNA, 25 bp, Artificial sequence
  Synthetic polynucleotide
  misc_feature: IgG1FcDELTA16_DE reverse primer
ttcatcgggccgagcggcgtggagc

SEQ ID NO: 410 - DNA, 25 bp, Artificial sequence
  Synthetic polynucleotide
  misc_feature: IgG1FcDELTA16_CE reverse primer
ttcgcagggccgagcggcgtggagc

SEQ ID NO: 411 - DNA, 25 bp, Artificial sequence
  Synthetic polynucleotide
  misc_feature: IgG1FcDELTA16_WE reverse primer
ttcccagggccgagcggcgtggagc

SEQ ID NO: 412 - DNA, 25 bp, Artificial sequence
  Synthetic polynucleotide
  misc_feature: IgG1FcDELTA16_PE reverse primer
ttccgggggccgagcggcgtggagc

SEQ ID NO: 413 - DNA, 25 bp, Artificial sequence
  Synthetic polynucleotide
  misc_feature: IgG1FcDELTA16_RE reverse primer
ttcacggggccgagcggcgtggagc

SEQ ID NO: 414 - DNA, 25 bp, Artificial sequence
  Synthetic polynucleotide
  misc_feature: IgG1FcDELTA16_TE reverse primer
ttcggtgggccgagcggcgtggagc

SEQ ID NO: 415 - DNA, 25 bp, Artificial sequence
  Synthetic polynucleotide
  misc_feature: IgG1FcDELTA16_AE reverse primer
ttccgcgggccgagcggcgtggagc

SEQ ID NO: 416 - DNA, 25 bp, Artificial sequence
  Synthetic polynucleotide
  misc_feature: IgG1FcDELTA16_GE reverse primer
ttcgccgggccgagcggcgtggagc

SEQ ID NO: 417 - DNA, 25 bp, Artificial sequence
  Synthetic polynucleotide
  misc_feature: IgG1FcDELTA16_SQ reverse primer
ctggctgggccgagcggcgtggagc

SEQ ID NO: 418 - DNA, 25 bp, Artificial sequence
  Synthetic polynucleotide
  misc_feature: IgG1FcDELTA16_FQ reverse primer
ctgaaagggccgagcggcgtggagc

SEQ ID NO: 419 - DNA, 25 bp, Artificial sequence
  Synthetic polynucleotide
  misc_feature: IgG1FcDELTA16_YQ reverse primer
ctgatagggccgagcggcgtggagc

SEQ ID NO: 420 - DNA, 25 bp, Artificial sequence
  Synthetic polynucleotide
  misc_feature: IgG1FcDELTA16_LQ reverse primer
ctgcaggggccgagcggcgtggagc

SEQ ID NO: 421 - DNA, 25 bp, Artificial sequence
  Synthetic polynucleotide
  misc_feature: IgG1FcDELTA16_HQ reverse primer
ctgatggggccgagcggcgtggagc

SEQ ID NO: 422 - DNA, 25 bp, Artificial sequence
  Synthetic polynucleotide
  misc_feature: IgG1FcDELTA16_QQ reverse primer
ctgctggggccgagcggcgtggagc

SEQ ID NO: 423 - DNA, 25 bp, Artificial sequence
  Synthetic polynucleotide
  misc_feature: IgG1FcDELTA16_IQ reverse primer
ctgaatgggccgagcggcgtggagc

SEQ ID NO: 424 - DNA, 25 bp, Artificial sequence
  Synthetic polynucleotide
  misc_feature: IgG1FcDELTA16_MQ reverse primer
ctgcatgggccgagcggcgtggagc

SEQ ID NO: 425 - DNA, 25 bp, Artificial sequence
  Synthetic polynucleotide
  misc_feature: IgG1FcDELTA16_NQ reverse primer
ctggttgggccgagcggcgtggagc

SEQ ID NO: 426 - DNA, 25 bp, Artificial sequence
  Synthetic polynucleotide
  misc_feature: IgG1FcDELTA16_KQ reverse primer
ctgtttgggccgagcggcgtggagc

SEQ ID NO: 427 - DNA, 25 bp, Artificial sequence
  Synthetic polynucleotide
  misc_feature: IgG1FcDELTA16_VQ reverse primer
ctgcacgggccgagcggcgtggagc

SEQ ID NO: 428 - DNA, 25 bp, Artificial sequence
  Synthetic polynucleotide
  misc_feature: IgG1FcDELTA16_EQ reverse primer
ctgctggggccgagcggcgtggagc

SEQ ID NO: 429 - DNA, 25 bp, Artificial sequence
  Synthetic polynucleotide
  misc_feature: IgG1FcDELTA16_DQ reverse primer
ctgatcgggccgagcggcgtggagc

SEQ ID NO: 430 - DNA, 25 bp, Artificial sequence
  Synthetic polynucleotide
  misc_feature: IgG1FcDELTA16_CQ reverse primer
ctggcagggccgagcggcgtggagc

SEQ ID NO: 431 - DNA, 25 bp, Artificial sequence
  Synthetic polynucleotide
  misc_feature: IgG1FcDELTA16_WQ reverse primer
ctgccagggccgagcggcgtggagc

SEQ ID NO: 432 - DNA, 25 bp, Artificial sequence
  Synthetic polynucleotide
  misc_feature: IgG1FcDELTA16_PQ reverse primer
ctgcgggggccgagcggcgtggagc

SEQ ID NO: 433 - DNA, 25 bp, Artificial sequence
  Synthetic polynucleotide
  misc_feature: IgG1FcDELTA16_RQ reverse primer
ctgacggggccgagcggcgtggagc

SEQ ID NO: 434 - DNA, 25 bp, Artificial sequence
  Synthetic polynucleotide
  misc_feature: IgG1FcDELTA16_TQ reverse primer
ctgggtgggccgagcggcgtggagc

SEQ ID NO: 435 - DNA, 25 bp, Artificial sequence
  Synthetic polynucleotide
  misc_feature: IgG1FcDELTA16_AQ reverse primer
ctgcgcgggccgagcggcgtggagc

SEQ ID NO: 436 - DNA, 25 bp, Artificial sequence
  Synthetic polynucleotide
  misc_feature: IgG1FcDELTA16_GQ reverse primer
ctggccgggccgagcggcgtggagc

SEQ ID NO: 437 - DNA, 20 bp, Artificial sequence
  Synthetic polynucleotide
  misc_feature: rituximab common reverse primer
aggtgctgggcacggtgggc

SEQ ID NO: 438 - DNA, 48 bp, Artificial sequence
  Synthetic polynucleotide
  misc_feature: Ritu-XXETCWDW forward primer
  misc_feature (1)..(2): N is any nucleotide
  misc_feature (3)..(3): K is G or T
  misc_feature (4)..(5): N is any nucleotide
  misc_feature (6)..(6): K is G or T
nnknnkgagacgtgttgggattgggtcttcctcttccccccaaaaccc

SEQ ID NO: 439 - DNA, 48 bp, Artificial sequence
  Synthetic polynucleotide
  misc_feature: Ritu-XXDDCWDW forward primer
  misc_feature (1)..(2): N is any nucleotide
  misc_feature (3)..(3): K is G or T
  misc_feature (4)..(5): N is any nucleotide
  misc_feature (6)..(6): K is G or T
nnknnkgatgattgttgggattgggtcttcctcttccccccaaaaccc

SEQ ID NO: 440 - DNA, 48 bp, Artificial sequence
  Synthetic polynucleotide
  misc_feature: Ritu-XXYDCWDW forward primer
  misc_feature (1)..(2): N is any nucleotide
  misc_feature (3)..(3): K is G or T
  misc_feature (4)..(5): N is any nucleotide
  misc_feature (6)..(6): K is G or T
nnknnktatgattgttgggattgggtcttcctcttccccccaaaaccc

SEQ ID NO: 441 - DNA, 45 bp, Artificial sequence
  Synthetic polynucleotide
  misc_feature: Ritu-XETCWDW forward primer
  misc_feature (1)..(2): N is any nucleotide
  misc_feature (3)..(3): K is G or T
nnkgagacgtgttgggattgggtcttcctcttccccccaaaaccc

SEQ ID NO: 442 - DNA, 45 bp, Artificial sequence
  Synthetic polynucleotide
  misc_feature: Ritu-XDDCWDW forward primer
  misc_feature (1)..(2): N is any nucleotide
  misc_feature (3)..(3): K is G or T
nnkgatgattgttgggattgggtcttcctcttccccccaaaaccc

SEQ ID NO: 443 - DNA, 45 bp, Artificial sequence
  Synthetic polynucleotide
  misc_feature: Ritu-XYDCWDW forward primer
  misc_feature (1)..(2): N is any nucleotide
  misc_feature (3)..(3): K is G or T
nnktatgattgttgggattgggtcttcctcttccccccaaaaccc

SEQ ID NO: 444 - DNA, 30 bp, Artificial sequence
  Synthetic polynucleotide
  misc_feature: Ritu-FETCWDW forward primer
tttgagacgtgttgggattgggtcttcctc

SEQ ID NO: 445 - DNA, 30 bp, Artificial sequence
  Synthetic polynucleotide
  misc_feature: Ritu-YETCWDW forward primer
tatgagacgtgttgggattgggtcttcctc

SEQ ID NO: 446 - DNA, 30 bp, Artificial sequence
  Synthetic polynucleotide
  misc_feature: Ritu-LETCWDW forward primer
ctggagacgtgttgggattgggtcttcctc

SEQ ID NO: 447 - DNA, 30 bp, Artificial sequence
  Synthetic polynucleotide
  misc_feature: Ritu-HETCWDW forward primer
catgagacgtgttgggattgggtcttcctc

SEQ ID NO: 448 - DNA, 30 bp, Artificial sequence
  Synthetic polynucleotide
  misc_feature: Ritu-QETCWDW forward primer
caggagacgtgttgggattgggtcttcctc

SEQ ID NO: 449 - DNA, 30 bp, Artificial sequence
  Synthetic polynucleotide
  misc_feature: Ritu-IETCWDW forward primer
attgagacgtgttgggattgggtcttcctc

SEQ ID NO: 450 - DNA, 30 bp, Artificial sequence
  Synthetic polynucleotide
  misc_feature: Ritu-METCWDW forward primer
atggagacgtgttgggattgggtcttcctc

SEQ ID NO: 451 - DNA, 30 bp, Artificial sequence
  Synthetic polynucleotide
  misc_feature: Ritu-NETCWDW forward primer
aacgagacgtgttgggattgggtcttcctc

SEQ ID NO: 452 - DNA, 30 bp, Artificial sequence
  Synthetic polynucleotide
  misc_feature: Ritu-KETCWDW forward primer
aaagagacgtgttgggattgggtcttcctc

SEQ ID NO: 453 - DNA, 30 bp, Artificial sequence
  Synthetic polynucleotide
  misc_feature: Ritu-VETCWDW forward primer
gtggagacgtgttgggattgggtcttcctc

SEQ ID NO: 454 - DNA, 30 bp, Artificial sequence
  Synthetic polynucleotide
  misc_feature: Ritu-DETCWDW forward primer
gatgagacgtgttgggattgggtcttcctc

SEQ ID NO: 455 - DNA, 30 bp, Artificial sequence
  Synthetic polynucleotide
  misc_feature: Ritu-SETCWDW forward primer
agcgagacgtgttgggattgggtcttcctc

SEQ ID NO: 456 - DNA, 30 bp, Artificial sequence
  Synthetic polynucleotide
  misc_feature: Ritu-CETCWDW forward primer
tgcgagacgtgttgggattgggtcttcctc

SEQ ID NO: 457 - DNA, 30 bp, Artificial sequence
  Synthetic polynucleotide
  misc_feature: Ritu-WETCWDW forward primer
tgggagacgtgttgggattgggtcttcctc

SEQ ID NO: 458 - DNA, 30 bp, Artificial sequence
  Synthetic polynucleotide
  misc_feature: Ritu-PETCWDW forward primer
ccggagacgtgttgggattgggtcttcctc

SEQ ID NO: 459 - DNA, 30 bp, Artificial sequence
  Synthetic polynucleotide
  misc_feature: Ritu-RETCWDW forward primer
cgtgagacgtgttgggattgggtcttcctc

SEQ ID NO: 460 - DNA, 30 bp, Artificial sequence
  Synthetic polynucleotide
  misc_feature: Ritu-TETCWDW forward primer
accgagacgtgttgggattgggtcttcctc

SEQ ID NO: 461 - DNA, 30 bp, Artificial sequence
  Synthetic polynucleotide
  misc_feature: Ritu-AETCWDW forward primer
gcggagacgtgttgggattgggtcttcctc

SEQ ID NO: 462 - DNA, 30 bp, Artificial sequence
  Synthetic polynucleotide
  misc_feature: Ritu-GETCWDW forward primer
ggcgagacgtgttgggattgggtcttcctc

SEQ ID NO: 463 - DNA, 30 bp, Artificial sequence
  Synthetic polynucleotide
  misc_feature: Ritu-EFTCWDW forward primer
gaatttacgtgttgggattgggtcttcctc

SEQ ID NO: 464 - DNA, 30 bp, Artificial sequence
  Synthetic polynucleotide
  misc_feature: Ritu-EYTCWDW forward primer
gaatatacgtgttgggattgggtcttcctc

SEQ ID NO: 465 - DNA, 30 bp, Artificial sequence
  Synthetic polynucleotide
  misc_feature: Ritu-ELTCWDW forward primer
gaactgacgtgttgggattgggtcttcctc

SEQ ID NO: 466 - DNA, 30 bp, Artificial sequence
  Synthetic polynucleotide
  misc_feature: Ritu-EHTCWDW forward primer
gaacatacgtgttgggattgggtcttcctc

SEQ ID NO: 467 - DNA, 30 bp, Artificial sequence
  Synthetic polynucleotide
  misc_feature: Ritu-EQTCWDW forward primer
gaacagacgtgttgggattgggtcttcctc

SEQ ID NO: 468 - DNA, 30 bp, Artificial sequence
  Synthetic polynucleotide
  misc_feature: Ritu-EITCWDW forward primer
gaaattacgtgttgggattgggtcttcctc

SEQ ID NO: 469 - DNA, 30 bp, Artificial sequence
  Synthetic polynucleotide
  misc_feature: Ritu-EMTCWDW forward primer
gaaatgacgtgttgggattgggtcttcctc

SEQ ID NO: 470 - DNA, 30 bp, Artificial sequence
  Synthetic polynucleotide
  misc_feature: Ritu-ENTCWDW
gaaaacacgtgttgggattgggtcttcctc

SEQ ID NO: 471 - DNA, 30 bp, Artificial sequence
  Synthetic polynucleotide
  misc_feature: Ritu-EKTCWDW forward primer
gaaaaaacgtgttgggattgggtcttcctc

SEQ ID NO: 472 - DNA, 30 bp, Artificial sequence
  Synthetic polynucleotide
  misc_feature: Ritu-EVTCWDW forward primer
gaagtgacgtgttgggattgggtcttcctc

SEQ ID NO: 473 - DNA, 30 bp, Artificial sequence
  Synthetic polynucleotide
  misc_feature: Ritu-EDTCWDW
gaagatacgtgttgggattgggtcttcctc

SEQ ID NO: 474 - DNA, 30 bp, Artificial sequence
  Synthetic polynucleotide
  misc_feature: Ritu-ESTCWDW forward primer
gaaagcacgtgttgggattgggtcttcctc

SEQ ID NO: 475 - DNA, 30 bp, Artificial sequence
  Synthetic polynucleotide
  misc_feature: Ritu-ECTCWDW forward primer
gaatgcacgtgttgggattgggtcttcctc

SEQ ID NO: 476 - DNA, 30 bp, Artificial sequence
  Synthetic polynucleotide
  misc_feature: Ritu-EWTCWDW forward primer
gaatggacgtgttgggattgggtcttcctc

SEQ ID NO: 477 - DNA, 30 bp, Artificial sequence
  Synthetic polynucleotide
  misc_feature: Ritu-EPTCWDW forward primer
gaaccgacgtgttgggattgggtcttcctc

SEQ ID NO: 478 - DNA, 30 bp, Artificial sequence
  Synthetic polynucleotide
  misc_feature: Ritu-ERTCWDW forward primer
gaacgtacgtgttgggattgggtcttcctc

SEQ ID NO: 479 - DNA, 30 bp, Artificial sequence
  Synthetic polynucleotide
  misc_feature: Ritu-ETTCWDW forward primer
gaaaccacgtgttgggattgggtcttcctc

SEQ ID NO: 480 - DNA, 30 bp, Artificial sequence
  Synthetic polynucleotide
  misc_feature: Ritu-EATCWDW forward primer
gaagcgacgtgttgggattgggtcttcctc

SEQ ID NO: 481 - DNA, 30 bp, Artificial sequence
  Synthetic polynucleotide
  misc_feature: Ritu-EGTCWDW forward primer
gaaggcacgtgttgggattgggtcttcctc

SEQ ID NO: 482 - DNA, 30 bp, Artificial sequence
  Synthetic polynucleotide
  misc_feature: Ritu-EEFCWDW forward primer
gaagagttttgttgggattgggtcttcctc

SEQ ID NO: 483 - DNA, 30 bp, Artificial sequence
  Synthetic polynucleotide
  misc_feature: Ritu-EEYCWDW forward primer
gaagagtattgttgggattgggtcttcctc

SEQ ID NO: 484 - DNA, 30 bp, Artificial sequence
  Synthetic polynucleotide
  misc_feature: Ritu-EELCWDW forward primer
gaagagctgtgttgggattgggtcttcctc

SEQ ID NO: 485 - DNA, 30 bp, Artificial sequence
  Synthetic polynucleotide
  misc_feature: Ritu-EEHCWDW forward primer
gaagagcattgttgggattgggtcttcctc

SEQ ID NO: 486 - DNA, 30 bp, Artificial sequence
  Synthetic polynucleotide
  misc_feature: Ritu-EEQCWDW forward primer
gaagagcagtgttgggattgggtcttcctc

SEQ ID NO: 487 - DNA, 30 bp, Artificial sequence
  Synthetic polynucleotide
  misc_feature: Ritu-EEICWDW forward primer
gaagagatttgttgggattgggtcttcctc

SEQ ID NO: 488 - DNA, 30 bp, Artificial sequence
  Synthetic polynucleotide
  misc_feature: Ritu-EEMCWDW forward primer
gaagagatgtgttgggattgggtcttcctc

SEQ ID NO: 489 - DNA, 30 bp, Artificial sequence
  Synthetic polynucleotide
  misc_feature: Ritu-EENCWDW forward primer
gaagagaactgttgggattgggtcttcctc

SEQ ID NO: 490 - DNA, 30 bp, Artificial sequence
  Synthetic polynucleotide
  misc_feature: Ritu-EEKCWDW forward primer
gaagagaaatgttgggattgggtcttcctc

SEQ ID NO: 491 - DNA, 30 bp, Artificial sequence
  Synthetic polynucleotide
  misc_feature: Ritu-EEVCWDW forward primer
gaagaggtgtgttgggattgggtcttcctc

SEQ ID NO: 492 - DNA, 30 bp, Artificial sequence
  Synthetic polynucleotide
  misc_feature: Ritu-EEECWDW forward primer
gaagaggaatgttgggattgggtcttcctc

SEQ ID NO: 493 - DNA, 30 bp, Artificial sequence
  Synthetic polynucleotide
  misc_feature: Ritu-EEDCWDW forward primer
gaagaggattgttgggattgggtcttcctc

SEQ ID NO: 494 - DNA, 30 bp, Artificial sequence
  Synthetic polynucleotide
  misc_feature: Ritu-EESCWDW forward primer
gaagagagctgttgggattgggtcttcctc

SEQ ID NO: 495 - DNA, 30 bp, Artificial sequence
  Synthetic polynucleotide
  misc_feature: Ritu-EECCWDW forward primer
gaagagtgctgttgggattgggtcttcctc

SEQ ID NO: 496 - DNA, 30 bp, Artificial sequence
  Synthetic polynucleotide
  misc_feature: Ritu-EEWCWDW forward primer
gaagagtggtgttgggattgggtcttcctc

SEQ ID NO: 497 - DNA, 30 bp, Artificial sequence
  Synthetic polynucleotide
  misc_feature: Ritu-EEPCWDW forward primer
gaagagccgtgttgggattgggtcttcctc

SEQ ID NO: 498 - DNA, 30 bp, Artificial sequence
  Synthetic polynucleotide
  misc_feature: Ritu-EERCWDW forward primer
gaagagcgttgttgggattgggtcttcctc

SEQ ID NO: 499 - DNA, 30 bp, Artificial sequence
  Synthetic polynucleotide
  misc_feature: Ritu-EEACWDW forward primer
gaagaggcgtgttgggattgggtcttcctc

SEQ ID NO: 500 - DNA, 30 bp, Artificial sequence
  Synthetic polynucleotide
  misc_feature: Ritu-EEGCWDW forward primer
gaagagggctgttgggattgggtcttcctc

SEQ ID NO: 501 - DNA, 30 bp, Artificial sequence
  Synthetic polynucleotide
  misc_feature: Ritu-EETFWDW forward primer
gaagagacgttttgggattgggtcttcctc

SEQ ID NO: 502 - DNA, 30 bp, Artificial sequence
  Synthetic polynucleotide
  misc_feature: Ritu-EETYWDW forward primer
gaagagacgtattgggattgggtcttcctc

SEQ ID NO: 503 - DNA, 30 bp, Artificial sequence
  Synthetic polynucleotide
  misc_feature: Ritu-EETLWDW forward primer
gaagagacgctgtgggattgggtcttcctc

SEQ ID NO: 504 - DNA, 30 bp, Artificial sequence
  Synthetic polynucleotide
  misc_feature: Ritu-EETHWDW forward primer
gaagagacgcattgggattgggtcttcctc

SEQ ID NO: 505 - DNA, 30 bp, Artificial sequence
  Synthetic polynucleotide
  misc_feature: Ritu-EETQWDW forward primer
gaagagacgcagtgggattgggtcttcctc

SEQ ID NO: 506 - DNA, 30 bp, Artificial sequence
  Synthetic polynucleotide
  misc_feature: Ritu-EETIWDW forward primer
gaagagacgatttgggattgggtcttcctc

SEQ ID NO: 507 - DNA, 30 bp, Artificial sequence
  Synthetic polynucleotide
  misc_feature: Ritu-EETMWDW forward primer
gaagagacgatgtgggattgggtcttcctc

SEQ ID NO: 508 - DNA, 30 bp, Artificial sequence
  Synthetic polynucleotide
  misc_feature: Ritu-EETNWDW forward primer
gaagagacgaactgggattgggtcttcctc

SEQ ID NO: 509 - DNA, 30 bp, Artificial sequence
  Synthetic polynucleotide
  misc_feature: Ritu-EETKWDW forward primer
gaagagacgaaatgggattgggtcttcctc

SEQ ID NO: 510 - DNA, 30 bp, Artificial sequence
  Synthetic polynucleotide
  misc_feature: Ritu-EETVWDW forward primer
gaagagacggtgtgggattgggtcttcctc

SEQ ID NO: 511 - DNA, 30 bp, Artificial sequence
  Synthetic polynucleotide
  misc_feature: Ritu-EETEWDW forward primer
gaagagacggaatgggattgggtcttcctc

SEQ ID NO: 512 - DNA, 30 bp, Artificial sequence
  Synthetic polynucleotide
  misc_feature: Ritu-EETDWDW forward primer
gaagagacggattgggattgggtcttcctc

SEQ ID NO: 513 - DNA, 30 bp, Artificial sequence
  Synthetic polynucleotide
  misc_feature: Ritu-EETSWDW forward primer
gaagagacgagctgggattgggtcttcctc

SEQ ID NO: 514 - DNA, 30 bp, Artificial sequence
  Synthetic polynucleotide
  misc_feature: Ritu-EETWWDW forward primer
gaagagacgtggtgggattgggtcttcctc

SEQ ID NO: 515 - DNA, 30 bp, Artificial sequence
  Synthetic polynucleotide
  misc_feature: Ritu-EETPWDW forward primer
gaagagacgccgtgggattgggtcttcctc

SEQ ID NO: 516 - DNA, 30 bp, Artificial sequence
  Synthetic polynucleotide
  misc_feature: Ritu-EETRWDW forward primer
gaagagacgcgttgggattgggtcttcctc

SEQ ID NO: 517 - DNA, 30 bp, Artificial sequence
  Synthetic polynucleotide
  misc_feature: Ritu-EETTWDW forward primer
gaagagacgacctgggattgggtcttcctc

SEQ ID NO: 518 - DNA, 30 bp, Artificial sequence
  Synthetic polynucleotide
  misc_feature: Ritu-EETAWDW forward primer
gaagagacggcgtgggattgggtcttcctc

SEQ ID NO: 519 - DNA, 30 bp, Artificial sequence
  Synthetic polynucleotide
  misc_feature: Ritu-EETGWDW forward primer
gaagagacgggctgggattgggtcttcctc

SEQ ID NO: 520 - DNA, 35 bp, Artificial sequence
  Synthetic polynucleotide
  misc_feature: Ritu-EETCWDD forward primer
gaagagacgtgttgggatgatgtcttcctcttccc

SEQ ID NO: 521 - DNA, 30 bp, Artificial sequence
  Synthetic polynucleotide
  misc_feature: Ritu-EETQWDD forward primer
gaagagacgcagtgggatgatgtcttcctc

SEQ ID NO: 522 - DNA, 36 bp, Artificial sequence
  Synthetic polynucleotide
  misc_feature: IgG1FcDELTA16_xxxx forward primer
  misc_feature (1)..(2): N is any nucleotide
  misc_feature (3)..(3): K is G or T
  misc_feature (4)..(5): N is any nucleotide
  misc_feature (6)..(6): K is G or T
  misc_feature (7)..(8): N is any nucleotide
  misc_feature (9)..(9): K is G or T
  misc_feature (10)..(11): N is any nucleotide
  misc_feature (12)..(12): K is G or T
nnknnknnknnkgtcttcctcttccccccaaaaccc

SEQ ID NO: 523 - DNA, 39 bp, Artificial sequence
  Synthetic polynucleotide
  misc_feature: IgG1FcDELTA16_xxxxx forward primer
  misc_feature (1)..(2): N is any nucleotide
  misc_feature (3)..(3): K is G or T
  misc_feature (4)..(5): N is any nucleotide
  misc_feature (6)..(6): K is G or T
  misc_feature (7)..(8): N is any nucleotide
  misc_feature (9)..(9): K is G or T
  misc_feature (10)..(11): N is any nucleotide
  misc_feature (12)..(12): K is G or T
  misc_feature (13)..(14): N is any nucleotide
  misc_feature (15)..(15): K is G or T
nnknnknnknnknnkgtcttcctcttccccccaaaaccc

SEQ ID NO: 524 - DNA, 42 bp, Artificial sequence
  Synthetic polynucleotide
  misc_feature: IgG1FcDELTA16_xxxxxx forward primer
  misc_feature (1)..(2): N is any nucleotide
  misc_feature (3)..(3): K is G or T
  misc_feature (4)..(5): N is any nucleotide
  misc_feature (6)..(6): K is G or T
  misc_feature (7)..(8): N is any nucleotide
  misc_feature (9)..(9): K is G or T
  misc_feature (10)..(11): N is any nucleotide
  misc_feature (12)..(12): K is G or T
  misc_feature (13)..(14): N is any nucleotide
  misc_feature (15)..(15): K is G or T
  misc_feature (16)..(17): N is any nucleotide
  misc_feature (18)..(18): K is G or T
nnknnknnknnknnknnkgtcttcctcttccccccaaaaccc

SEQ ID NO: 525 - DNA, 45 bp, Artificial sequence
  Synthetic polynucleotide
  misc_feature: IgG1FcDELTA16_xxxxxxx forward primer
  misc_feature (1)..(2): N is any nucleotide
  misc_feature (3)..(3): K is G or T
  misc_feature (4)..(5): N is any nucleotide
  misc_feature (6)..(6): K is G or T
  misc_feature (7)..(8): N is any nucleotide
  misc_feature (9)..(9): K is G or T
  misc_feature (10)..(11): N is any nucleotide
  misc_feature (12)..(12): K is G or T
  misc_feature (13)..(14): N is any nucleotide
  misc_feature (15)..(15): K is G or T
  misc_feature (16)..(17): N is any nucleotide
  misc_feature (18)..(18): K is G or T
  misc_feature (19)..(20): N is any nucleotide
  misc_feature (21)..(21): K is G or T
nnknnknnknnknnknnknnkgtcttcctcttccccccaaaaccc

SEQ ID NO: 526 - DNA, 48 bp, Artificial sequence
  Synthetic polynucleotide
  misc_feature: IgG1FcDELTA16_xxxxxxxx forward primer
  misc_feature (1)..(2): N is any nucleotide
  misc_feature (3)..(3): K is G or T
  misc_feature (4)..(5): N is any nucleotide
  misc_feature (6)..(6): K is G or T
  misc_feature (7)..(8): N is any nucleotide
  misc_feature (9)..(9): K is G or T
  misc_feature (10)..(11): N is any nucleotide
  misc_feature (12)..(12): K is G or T
  misc_feature (13)..(14): N is any nucleotide
  misc_feature (15)..(15): K is G or T
  misc_feature (16)..(17): N is any nucleotide
  misc_feature (18)..(18): K is G or T
  misc_feature (19)..(20): N is any nucleotide
  misc_feature (21)..(21): K is G or T
  misc_feature (22)..(23): N is any nucleotide
  misc_feature (24)..(24): K is G or T
nnknnknnknnknnknnknnknnkgtcttcctcttccccccaaaaccc

SEQ ID NO: 527 - DNA, 51 bp, Artificial sequence
  Synthetic polynucleotide
  misc_feature: IgG1FcDELTA16_xxxxxxxxx forward primer
  misc_feature (1)..(2): N is any nucleotide
  misc_feature (3)..(3): K is G or T
  misc_feature (4)..(5): N is any nucleotide
  misc_feature (6)..(6): K is G or T
  misc_feature (7)..(8): N is any nucleotide
  misc_feature (9)..(9): K is G or T
  misc_feature (10)..(11): N is any nucleotide
  misc_feature (12)..(12): K is G or T
  misc_feature (13)..(14): N is any nucleotide
  misc_feature (15)..(15): K is G or T
  misc_feature (16)..(17): N is any nucleotide
  misc_feature (18)..(18): K is G or T
  misc_feature (19)..(20): N is any nucleotide
  misc_feature (21)..(21): K is G or T
  misc_feature (22)..(23): N is any nucleotide
  misc_feature (24)..(24): K is G or T
  misc_feature (25)..(26): N is any nucleotide
  misc_feature (27)..(27): K is G or T
nnknnknnknnknnknnknnknnknnkgtcttcctcttccccccaaaaccc

SEQ ID NO: 528 - DNA, 30 bp, Artificial sequence
  Synthetic polynucleotide
  misc_feature: IgG1FcDELTA16_xx forward primer
  misc_feature (1)..(2): N is any nucleotide
  misc_feature (3)..(3): S is G or C
  misc_feature (4)..(5): N is any nucleotide
  misc_feature (6)..(6): S is G or C
nnsnnsgtcttcctcttccccccaaaaccc

SEQ ID NO: 529 - DNA, 33 bp, Artificial sequence
  Synthetic polynucleotide
  misc_feature: IgG1FcDELTA16_xxx forward primer
  misc_feature (1)..(2): N is any nucleotide
  misc_feature (3)..(3): S is G or C
  misc_feature (4)..(5): N is any nucleotide
  misc_feature (6)..(6): S is G or C
  misc_feature (7)..(8): N is any nucleotide
  misc_feature (9)..(9): S is G or C
nnsnnsnnsgtcttcctcttccccccaaaaccc

SEQ ID NO: 530 - DNA, 36 bp, Artificial sequence
  Synthetic polynucleotide
  misc_feature: IgG1FcDELTA16_xxxx forward primer
  misc_feature (1)..(2): N is any nucleotide
  misc_feature (3)..(3): N is any nucleotide
  misc_feature (4)..(5): N is any nucleotide
  misc_feature (6)..(6): N is any nucleotide
  misc_feature (7)..(8): N is any nucleotide
  misc_feature (9)..(9): N is any nucleotide
  misc_feature (10)..(11): N is any nucleotide
  misc_feature (12)..(12): N is any nucleotide
nnsnnsnnsnnsgtcttcctcttccccccaaaaccc

SEQ ID NO: 531 - DNA, 39 bp, Artificial sequence
  Synthetic polynucleotide
  misc_feature: IgG1FcDELTA16_xxxxx forward primer
  misc_feature (1)..(2): N is any nucleotide
  misc_feature (3)..(3): S is G or C
  misc_feature (4)..(5): N is any nucleotide
  misc_feature (6)..(6): S is G or C
  misc_feature (7)..(8): N is any nucleotide
  misc_feature (9)..(9): S is G or C
  misc_feature (10)..(11): N is any nucleotide
  misc_feature (12)..(12): S is G or C
  misc_feature (13)..(14): N is any nucleotide
  misc_feature (15)..(15): S is G or C
nnsnnsnnsnnsnnsgtcttcctcttccccccaaaaccc

SEQ ID NO: 532 - DNA, 42 bp, Artificial sequence
  Synthetic polynucleotide
  misc_feature: IgG1FcDELTA16_xxxxxx forward primer
  misc_feature (1)..(2): N is any nucleotide
  misc_feature (3)..(3): S is G or C
  misc_feature (4)..(5): N is any nucleotide
  misc_feature (6)..(6): S is G or C
  misc_feature (7)..(8): N is any nucleotide
  misc_feature (9)..(9): S is G or C
  misc_feature (10)..(11): N is any nucleotide
  misc_feature (12)..(12): S is G or C
  misc_feature (13)..(14): N is any nucleotide
  misc_feature (15)..(15): S is G or C
  misc_feature (16)..(17): N is any nucleotide
  misc_feature (18)..(18): S is G or C
nnsnnsnnsnnsnnsnnsgtcttcctcttccccccaaaaccc

SEQ ID NO: 533 - DNA, 45 bp, Artificial sequence
  Synthetic polynucleotide
  misc_feature: IgG1FcDELTA16_xxxxxxx forward primer
  misc_feature (1)..(2): N is any nucleotide
  misc_feature (3)..(3): S is G or C
  misc_feature (4)..(5): N is any nucleotide
  misc_feature (6)..(6): S is G or C
  misc_feature (7)..(8): N is any nucleotide
  misc_feature (9)..(9): S is G or C
  misc_feature (10)..(11): N is any nucleotide
  misc_feature (12)..(12): S is G or C
  misc_feature (13)..(14): N is any nucleotide
  misc_feature (15)..(15): S is G or C
  misc_feature (16)..(17): N is any nucleotide
  misc_feature (18)..(18): S is G or C
  misc_feature (19)..(20): N is any nucleotide
  misc_feature (21)..(21): S is G or C
nnsnnsnnsnnsnnsnnsnnsgtcttcctcttccccccaaaaccc

SEQ ID NO: 534 - DNA, 48 bp, Artificial sequence
  Synthetic polynucleotide
  misc_feature: IgG1FcDELTA16_xxxxxxxx forward primer
  misc_feature (1)..(2): N is any nucleotide
  misc_feature (3)..(3): S is G or C
  misc_feature (4)..(5): N is any nucleotide
  misc_feature (6)..(6): S is G or C
  misc_feature (7)..(8): N is any nucleotide
  misc_feature (9)..(9): S is G or C
  misc_feature (10)..(11): N is any nucleotide
  misc_feature (12)..(12): S is G or C
  misc_feature (13)..(14): N is any nucleotide
  misc_feature (15)..(15): S is G or C
  misc_feature (16)..(17): N is any nucleotide
  misc_feature (18)..(18): S is G or C
  misc_feature (19)..(20): N is any nucleotide
  misc_feature (21)..(21): S is G or C
  misc_feature (22)..(23): N is any nucleotide
  misc_feature (24)..(24): S is G or C
nnsnnsnnsnnsnnsnnsnnsnnsgtcttcctcttccccccaaaaccc

SEQ ID NO: 535 - DNA, 51 bp, Artificial sequence
  Synthetic polynucleotide
  misc_feature: IgG1FcDELTA16_xxxxxxxxx forward primer
  misc_feature (1)..(2): N is any nucleotide
  misc_feature (3)..(3): S is G or C
  misc_feature (4)..(5): N is any nucleotide
  misc_feature (6)..(6): S is G or C
  misc_feature (7)..(8): N is any nucleotide
  misc_feature (9)..(9): S is G or C
  misc_feature (10)..(11): N is any nucleotide
  misc_feature (12)..(12): S is G or C
  misc_feature (13)..(14): N is any nucleotide
  misc_feature (15)..(15): S is G or C
  misc_feature (16)..(17): N is any nucleotide
  misc_feature (18)..(18): S is G or C
  misc_feature (19)..(20): N is any nucleotide
  misc_feature (21)..(21): S is G or C
  misc_feature (22)..(23): N is any nucleotide
  misc_feature (24)..(24): S is G or C
  misc_feature (25)..(26): N is any nucleotide
  misc_feature (27)..(27): S is G or C
nnsnnsnnsnnsnnsnnsnnsnnsnnsgtcttcctcttccccccaaaaccc

SEQ ID NO: 536 - DNA, 24 bp, Artificial sequence
  Synthetic polynucleotide
  misc_feature: IgG1FcDELTA16_xx forward primer
  misc_feature (1)..(1): (trimer phosphoroamidites)2
gtcttcctcttccccccaaaaccc

SEQ ID NO: 537 - DNA, 24 bp, Artificial sequence
  Synthetic polynucleotide
  misc_feature: IgG1FcDELTA16_xxx forward primer
  misc_feature (1)..(1): (trimer phosphoroamidites)3
gtcttcctcttccccccaaaaccc

SEQ ID NO: 538 - DNA, 24 bp, Artificial sequence
  Synthetic polynucleotide
  misc_feature: IgG1FcDELTA16_xxxx forward primer
  misc_feature (1)..(1): (trimer phosphoroamidites)4
gtcttcctcttccccccaaaaccc

SEQ ID NO: 539 - DNA, 24 bp, Artificial sequence
  Synthetic polynucleotide
  misc_feature: IgG1FcDELTA16_xxxxx forward primer
  misc_feature (1)..(1): (trimer phosphoroamidites)5
gtcttcctcttccccccaaaaccc

SEQ ID NO: 540 - DNA, 24 bp, Artificial sequence
  Synthetic polynucleotide
  misc_feature: IgG1FcDELTA16_xxxxxx forward primer
  misc_feature (1)..(1): (trimer phosphoroamidites)6
gtcttcctcttccccccaaaaccc

SEQ ID NO: 541 - DNA, 24 bp, Artificial sequence
  Synthetic polynucleotide
  misc_feature: IgG1FcDELTA16_xxxxxxx forward primer
  misc_feature (1)..(1): (trimer phosphoroamidites)7
gtcttcctcttccccccaaaaccc

SEQ ID NO: 542 - DNA, 24 bp, Artificial sequence
  Synthetic polynucleotide
  misc_feature: IgG1FcDELTA16_xxxxxxxx forward primer
  misc_feature (1)..(1): (trimer phosphoroamidites)8
gtcttcctcttccccccaaaaccc

SEQ ID NO: 543 - DNA, 24 bp, Artificial sequence
  Synthetic polynucleotide
  misc_feature: IgG1FcDELTA16_xxxxxxxxx forward primer
  misc_feature (1)..(1): (trimer phosphoroamidites)9
gtcttcctcttccccccaaaaccc

SEQ ID NO: 544 - protein, 7 aa, Artificial sequence
  Synthetic polypeptide
  misc_feature: wild type lower hinge amino acid sequence
ELLGGPS

SEQ ID NO: 545 - protein, 7 aa, Artificial sequence
  Synthetic polypeptide
  misc_feature: novel protease-resistant hinge sequence
EETCWDW

SEQ ID NO: 546 - protein, 7 aa, Artificial sequence
  Synthetic polypeptide
  misc_feature: novel protease-resistant hinge sequence
EDSCWDW

SEQ ID NO: 547 - protein, 7 aa, Artificial sequence
  Synthetic polypeptide
  misc_feature: novel protease-resistant hinge sequence
EETCWSW

SEQ ID NO: 548 - DNA, 21 bp, Artificial sequence
  Synthetic polynucleotide
  misc_feature: nucleic acid sequence that encodes wildtype CDR1
tataccttcacaaggtataat

SEQ ID NO: 549 - DNA, 21 bp, Artificial sequence
  Synthetic polynucleotide
  misc_feature: nucleic acid sequence that encodes wildtype CDR2
atttatccgggcaacggcgat

SEQ ID NO: 550 - DNA, 36 bp, Artificial sequence
  Synthetic polynucleotide
  misc_feature: nucleic acid sequence that encodes wildtype CDR3
cgcagcacctattatggcggcgattggtattttaac

SEQ ID NO: 551 - DNA, 21 bp, Artificial sequence
  Synthetic polynucleotide
  misc_feature: CDR1 clone P01A09
tataccgggaagcggtataac

SEQ ID NO: 552 - DNA, 21 bp, Artificial sequence
  Synthetic polynucleotide
  misc_feature: CDR1 clone P01B01
tatacctgttttaggtataac

SEQ ID NO: 553 - DNA, 21 bp, Artificial sequence
  Synthetic polynucleotide
  misc_feature: CDR1 clone P02C12
tataccttcacaattcgtttg

SEQ ID NO: 554 - DNA, 21 bp, Artificial sequence
  Synthetic polynucleotide
  misc_feature: CDR1 clone P02F01
tataccgggcgtttttataac

SEQ ID NO: 555 - DNA, 21 bp, Artificial sequence
  Synthetic polynucleotide
  misc_feature: CDR1 clone P03A05
tataccagttggatgtataac

SEQ ID NO: 556 - DNA, 21 bp, Artificial sequence
  Synthetic polynucleotide
  misc_feature: CDR1 clone P05B09
tggttgtggacaagctataac

SEQ ID NO: 557 - DNA, 21 bp, Artificial sequence
  Synthetic polynucleotide
  misc_feature: CDR1 clone P05H07
tatacctgggggatttataac

SEQ ID NO: 558 - DNA, 21 bp, Artificial sequence
  Synthetic polynucleotide
  misc_feature: CDR1 clone P04A02
tataccttcacaaggtataat

SEQ ID NO: 559 - DNA, 21 bp, Artificial sequence
  Synthetic polynucleotide
  misc_feature: CDR1 clone P05F06
tataccttcacatttccttat

SEQ ID NO: 560 - DNA, 21 bp, Artificial sequence
  Synthetic polynucleotide
  misc_feature: CDR1 clone P07C04
tataccggtattcggtataac

SEQ ID NO: 561 - DNA, 21 bp, Artificial sequence
  Synthetic polynucleotide
  misc_feature: CDR2 clone P04D06
atttatccgggcttgtatctt

SEQ ID NO: 562 - DNA, 21 bp, Artificial sequence
  Synthetic polynucleotide
  misc_feature: CDR2 clone P04F01
atttatccgggcacgctgctg

SEQ ID NO: 563 - DNA, 21 bp, Artificial sequence
  Synthetic polynucleotide
  misc_feature: CDR2 clone P04F02
atttatccgggccatatgggg

SEQ ID NO: 564 - DNA, 21 bp, Artificial sequence
  Synthetic polynucleotide
  misc_feature: CDR2 clone P04G03
atttatccgggcatgctttgg

SEQ ID NO: 565 - DNA, 21 bp, Artificial sequence
  Synthetic polynucleotide
  misc_feature: CDR2 clone P04H06
atttatccgggcgctgtttcg

SEQ ID NO: 566 - DNA, 21 bp, Artificial sequence
  Synthetic polynucleotide
  misc_feature: CDR2 clone P04H07
atttatccgggcactcataag

SEQ ID NO: 567 - DNA, 21 bp, Artificial sequence
  Synthetic polynucleotide
  misc_feature: CDR2 clone P06A06
atttatccgggcactcagtct

SEQ ID NO: 568 - DNA, 21 bp, Artificial sequence
  Synthetic polynucleotide
  misc_feature: CDR2 clone P06B11
atttatccgggcaatgcggat

SEQ ID NO: 569 - DNA, 21 bp, Artificial sequence
  Synthetic polynucleotide
  misc_feature: CDR2 clone P06H01
atttatccgggcagttttgag

SEQ ID NO: 570 - DNA, 21 bp, Artificial sequence
  Synthetic polynucleotide
  misc_feature: CDR2 clone P04D09
atttatccgggcacgtttctt

SEQ ID NO: 571 - DNA, 21 bp, Artificial sequence
  Synthetic polynucleotide
  misc_feature: CDR2 clone P05A03
atttatccggttacgggcgat

SEQ ID NO: 572 - DNA, 21 bp, Artificial sequence
  Synthetic polynucleotide
  misc_feature: CDR2 clone P05A12
atttatccgtatctgggcgat

SEQ ID NO: 573 - DNA, 21 bp, Artificial sequence
  Synthetic polynucleotide
  misc_feature: CDR2 clone P05B02
atttatccgtggaatggcgat

SEQ ID NO: 574 - DNA, 21 bp, Artificial sequence
  Synthetic polynucleotide
  misc_feature: CDR2 clone P06B04
atttatcctctgtggggcgat

SEQ ID NO: 575 - DNA, 21 bp, Artificial sequence
  Synthetic polynucleotide
  misc_feature: CDR2 clone P06B11
atttatccgggcagtagtcgt

SEQ ID NO: 576 - DNA, 21 bp, Artificial sequence
  Synthetic polynucleotide
  misc_feature: CDR2 clone P06H05
atttatccgggcacttttcgt

SEQ ID NO: 577 - DNA, 21 bp, Artificial sequence
  Synthetic polynucleotide
  misc_feature: CDR2 clone P06H11
atttatccgggcgttggtcgg

SEQ ID NO: 578 - DNA, 21 bp, Artificial sequence
  Synthetic polynucleotide
  misc_feature: CDR2 clone P07F02
atttatccgggctctgaggcg

SEQ ID NO: 579 - DNA, 21 bp, Artificial sequence
  Synthetic polynucleotide
  misc_feature: CDR2 clone P07F10
atttatccgggcagtaatatg

SEQ ID NO: 580 - DNA, 21 bp, Artificial sequence
  Synthetic polynucleotide
  misc_feature: CDR2 clone P08B05
atttatccgggcgcttttctt

SEQ ID NO: 581 - DNA, 36 bp, Artificial sequence
  Synthetic polynucleotide
  misc_feature: CDR3 clone P07C02
cagtctatttattatggcggcgattggtattttaac

SEQ ID NO: 582 - DNA, 36 bp, Artificial sequence
  Synthetic polynucleotide
  misc_feature: CDR3 clone P07H08
cgcagcacctattatggcggcgattggctgattgct

SEQ ID NO: 583 - DNA, 36 bp, Artificial sequence
  Synthetic polynucleotide
  misc_feature: CDR3 clone P07H10
cgcagcaccgtggcggggggcgattggtattttaac

SEQ ID NO: 584 - DNA, 36 bp, Artificial sequence
  Synthetic polynucleotide
  misc_feature: CDR3 clone P08A01
cgcagcacctattatggcggcgattggcggtggcgg

SEQ ID NO: 585 - DNA, 36 bp, Artificial sequence
  Synthetic polynucleotide
  misc_feature: CDR3 clone P08B11
cgcagcacctattatggcgggttttggtattttaac

SEQ ID NO: 586 - DNA, 36 bp, Artificial sequence
  Synthetic polynucleotide
  misc_feature: CDR3 clone P08G02
cgcagcacctattatggcggcgattggtcttgggct

SEQ ID NO: 587 - DNA, 36 bp, Artificial sequence
  Synthetic polynucleotide
  misc_feature: CDR3 clone P07A06
cgcagcaccatgtgtaagggcgattggtattttaac

SEQ ID NO: 588 - DNA, 36 bp, Artificial sequence
  Synthetic polynucleotide
  misc_feature: CDR3 clone P08E05
cgcagcaccatgttgggtggcgattggtattttaac

SEQ ID NO: 589 - protein, 7 aa, Artificial Sequence
  Synthetic polypeptide
  MISC_FEATURE: Rituximab heavy chain, CDR1, amino acid sequence
YTFTSYN

SEQ ID NO: 590 - protein, 7 aa, Artificial Sequence
  Synthetic polypeptide
  MISC_FEATURE: Rituximab heavy chain, CDR2, amino acid sequence
IYPGNGD

SEQ ID NO: 591 - protein, 12 aa, Artificial Sequence
  Synthetic polypeptide
  MISC_FEATURE: Rituximab heavy chain, CDR3, amino acid sequence
RSTYYGGDWYFN

SEQ ID NO: 592 - protein, 7 aa, Artificial Sequence
  Synthetic polypeptide
  MISC_FEATURE: heavy chain CDR1 clone A-P01A09
YTGKRYN

SEQ ID NO: 593 - protein, 7 aa, Artificial Sequence
  Synthetic polypeptide
  MISC_FEATURE: heavy chain CDR1 clone A-P01B01
YTCFRYN

SEQ ID NO: 594 - protein, 7 aa, Artificial Sequence
  Synthetic polypeptide
  MISC_FEATURE: heavy chain CDR1 clone A-P02C12
YTFTIRL

SEQ ID NO: 595 - protein, 7 aa, Artificial Sequence
  Synthetic polypeptide
  MISC_FEATURE: heavy chain CDR1 clone A-P02F01
YTGRFYN

SEQ ID NO: 596 - protein, 7 aa, Artificial Sequence
  Synthetic polypeptide
  MISC_FEATURE: heavy chain CDR1 clone A-P03A03
YTSWMYN

SEQ ID NO: 597 - protein, 7 aa, Artificial Sequence
  Synthetic polypeptide
  MISC_FEATURE: heavy chain CDR1 clone A-P05B09
WLWTSYN

SEQ ID NO: 598 - protein, 7 aa, Artificial Sequence
  Synthetic polypeptide
  MISC_FEATURE: heavy chain CDR1 clone A-P05H07
YTWGIYN

SEQ ID NO: 599 - protein, 7 aa, Artificial Sequence
  Synthetic polypeptide
  MISC_FEATURE: CDR1 clone B-P04A02
YTFTRYN

SEQ ID NO: 600 - protein, 7 aa, Artificial Sequence
  Synthetic polypeptide
  MISC_FEATURE: heavy chain CDR1 clone B-P05F06
YTFTFPY

SEQ ID NO: 601 - protein, 7 aa, Artificial Sequence
  Synthetic polypeptide
  MISC_FEATURE: heavy chain CDR1 clone B-P07C04
YTGIRYN

SEQ ID NO: 602 - protein, 7 aa, Artificial Sequence
  Synthetic polypeptide
  MISC_FEATURE: heavy chain CDR clone A-P04D06
IYPGLYL

SEQ ID NO: 603 - protein, 7 aa, Artificial Sequence
  Synthetic polypeptide
  MISC_FEATURE: heavy chain CDR2 clone A-P04F01
IYPGTLL

SEQ ID NO: 604 - protein, 7 aa, Artificial Sequence
  Synthetic polypeptide
  MISC_FEATURE: heavy chain CDR2 clone A-P04F02
IYPGHMG

SEQ ID NO: 605 - protein, 7 aa, Artificial Sequence
  Synthetic polypeptide
  MISC_FEATURE: heavy chain CDR2 clone A-P04G03
IYPGMLW

SEQ ID NO: 606 - protein, 7 aa, Artificial Sequence
  Synthetic polypeptide
  MISC_FEATURE: heavy chain CDR2 clone A-P04H06
IYPGAVS

SEQ ID NO: 607 - protein, 7 aa, Artificial Sequence
  Synthetic polypeptide
  MISC_FEATURE: heavy chain CDR2 clone A-P04H07
IYPGTHK

SEQ ID NO: 608 - protein, 7 aa, Artificial Sequence
  Synthetic polypeptide
  MISC_FEATURE: heavy chain CDR2 clone A-P06A06
IYPGTQS

SEQ ID NO: 609 - protein, 7 aa, Artificial Sequence
  Synthetic polypeptide
  MISC_FEATURE: heavy chain CDR2 clone A-P06B11
IYPGNAD

SEQ ID NO: 610 - protein, 7 aa, Artificial Sequence
  Synthetic polypeptide
  MISC_FEATURE: heavy chain CDR2 clone A-P06H01
IYPGSFE

SEQ ID NO: 611 - protein, 7 aa, Artificial Sequence
  Synthetic polypeptide
  MISC_FEATURE: heavy chain CDR2 clone B-P04D09
IYPGTFL

SEQ ID NO: 612 - protein, 7 aa, Artificial Sequence
  Synthetic polypeptide
  MISC_FEATURE: heavy chain CDR2 clone B-P05A03
IYPVTGD

SEQ ID NO: 613 - protein, 7 aa, Artificial Sequence
  Synthetic polypeptide
  MISC_FEATURE: heavy chain CDR2 clone B-P05A12
IYPYLGD

SEQ ID NO: 614 - protein, 7 aa, Artificial Sequence
  Synthetic polypeptide
  MISC_FEATURE: heavy chain CDR2 clone B-P05B02
IYPWNGD

SEQ ID NO: 615 - protein, 7 aa, Artificial Sequence
  Synthetic polypeptide
  MISC_FEATURE: heavy chain CDR2 clone B-P06B04
IYPLWGD

SEQ ID NO: 616 - protein, 7 aa, Artificial Sequence
  Synthetic polypeptide
  MISC_FEATURE: heavy chain CDR2 clone B-P06B11
IYPGSSR

SEQ ID NO: 617 - protein, 7 aa, Artificial Sequence
  Synthetic polypeptide
  MISC_FEATURE: heavy chain CDR2 clone B-P06H05
IYPGTFR

SEQ ID NO: 618 - protein, 7 aa, Artificial Sequence
  Synthetic polypeptide
  MISC_FEATURE: heavy chain CDR2 clone B-P06H11
IYPGVGR

SEQ ID NO: 619 - protein, 7 aa, Artificial Sequence
  Synthetic polypeptide
  MISC_FEATURE: heavy chain CDR2 clone B-P07F02
IYPGSEA

SEQ ID NO: 620 - protein, 7 aa, Artificial Sequence
  Synthetic polypeptide
  MISC_FEATURE: heavy chain CDR2 clone B-P07F10
IYPGSNM

SEQ ID NO: 621 - protein, 7 aa, Artificial Sequence
  Synthetic polypeptide
  MISC_FEATURE: heavy chain CDR2 clone B-P08B05
IYPGAFL

SEQ ID NO: 622 - protein, 12 aa, Artificial Sequence
  Synthetic polypeptide
  MISC_FEATURE: heavy chain CDR3 clone A-P07C02
QSIYYGGDWYFN

SEQ ID NO: 623 - protein, 12 aa, Artificial Sequence
  Synthetic polypeptide
  MISC_FEATURE: heavy chain CDR3 clone A-P07H08
RSTYYGGDWLIA

SEQ ID NO: 624 - protein, 12 aa, Artificial Sequence
  Synthetic polypeptide
  MISC_FEATURE: heavy chain CDR3 clone A-P07H10
RSTVAGGDWYFN

SEQ ID NO: 625 - protein, 12 aa, Artificial Sequence
  Synthetic polypeptide
  MISC_FEATURE: heavy chain CDR3 clone A-P08A01
RSTYYGGDWRWR

SEQ ID NO: 626 - protein, 12 aa, Artificial Sequence
  Synthetic polypeptide
  MISC_FEATURE: heavy chain CDR3 clone A-P08B11
RSTYYGGFWYFN

SEQ ID NO: 627 - protein, 12 aa, Artificial Sequence
  Synthetic polypeptide
  MISC_FEATURE: heavy chain CDR3 clone A-P08G02
RSTYYGGDWSWA

SEQ ID NO: 628 - protein, 12 aa, Artificial Sequence
  Synthetic polypeptide
  MISC_FEATURE: heavy chain CDR3 clone B-P07A06
RSTMCKGDWYFN

SEQ ID NO: 629 - protein, 12 aa, Artificial Sequence
  Synthetic polypeptide
  MISC_FEATURE: heavy chain CDR3 clone B-P08E05
RSTMLGGDWYFN

SEQ ID NO: 630 - DNA, 18 bp, Artificial Sequence
  Synthetic polynucleotide
  misc_feature: Rituximab light chain, CDR1, nucleic acid sequence
gcgagcagcagcgtgagc

SEQ ID NO: 631 - DNA, 15 bp, Artificial Sequence
  Synthetic polynucleotide
  misc_feature: Rituximab light chain, CDR2, nucleic acid sequence
ggaagcggcaccagc

SEQ ID NO: 632 - DNA, 18 bp, Artificial Sequence
  Synthetic polynucleotide
  misc_feature: Rituximab light chain, CDR3, nucleic acid sequence
tggaccagcaacccgccg

SEQ ID NO: 633 - protein, 6 aa, Artificial Sequence
  Synthetic polypeptide
  MISC_FEATURE: Rituximab light chain, CDR1, amino acid sequence
ASSSVS

SEQ ID NO: 634 - protein, 5 aa, Artificial Sequence
  Synthetic polypeptide
  MISC_FEATURE: Rituximab light chain, CDR2, amino acid sequence
GSGTS

SEQ ID NO: 635 - protein, 6 aa, Artificial Sequence
  Synthetic polypeptide
  MISC_FEATURE: Rituximab light chain, CDR3, amino acid sequence
WTSNPP

SEQ ID NO: 636 - protein, 7 aa, Artificial Sequence
  Synthetic construct
EETQWDD

SEQ ID NO: 637 - protein, 7 aa, Artificial Sequence
  Synthetic construct
EETCWDD

SEQ ID NO: 638 - protein, 6 aa, Artificial Sequence
  Synthetic construct
FNCWDW

SEQ ID NO: 639 - protein, 6 aa, Artificial Sequence
  Synthetic construct
EFCWDW

SEQ ID NO: 640 - protein, 6 aa, Artificial Sequence
  Synthetic construct
DVCWDW

SEQ ID NO: 641 - protein, 6 aa, Artificial Sequence
  Synthetic construct
IICWDW

SEQ ID NO: 642 - protein, 6 aa, Artificial Sequence
  Synthetic construct
EHCWDW

SEQ ID NO: 643 - protein, 6 aa, Artificial Sequence
  Synthetic construct
DMCWDW

SEQ ID NO: 644 - protein, 6 aa, Artificial Sequence
  Synthetic construct
DDCWDW

SEQ ID NO: 645 - protein, 6 aa, Artificial Sequence
  Synthetic construct
YDCWDW

SEQ ID NO: 646 - protein, 6 aa, Artificial Sequence
  Synthetic construct
DSCWDW

SEQ ID NO: 647 - protein, 6 aa, Artificial Sequence
  Synthetic construct
ETCWDW

SEQ ID NO: 648 - protein, 4 aa, Artificial Sequence
  Synthetic construct
CWDW

SEQ ID NO: 649 - protein, 5 aa, Artificial Sequence
  Synthetic construct
  misc_feature (1)..(1): Xaa can be any naturally occurring amino acid
XCWDW

SEQ ID NO: 650 - protein, 6 aa, Artificial Sequence
  Synthetic construct
  misc_feature (1)..(2): Xaa can be any naturally occurring amino acid
XXCWDW

SEQ ID NO: 651 - protein, 7 aa, Artificial Sequence
  Synthetic construct
  misc_feature (1)..(3): Xaa can be any naturally occurring amino acid
XXXCWDW

SEQ ID NO: 652 - protein, 9 aa, Artificial Sequence
  Synthetic construct
  misc_feature (1)..(5): Xaa can be any naturally occurring amino acid
XXXXXCWDW

SEQ ID NO: 653 - protein, 10 aa, Artificial Sequence
  Synthetic construct
  misc_feature (1)..(6): Xaa can be any naturally occurring amino acid
XXXXXXCWDW

SEQ ID NO: 654 - protein, 11 aa, Artificial Sequence
  Synthetic construct
  misc_feature (1)..(7): Xaa can be any naturally occurring amino acid
XXXXXXXCWDW

SEQ ID NO: 655 - protein, 4 aa, Artificial Sequence
  Synthetic construct
YSDW

SEQ ID NO: 656 - protein, 4 aa, Artificial Sequence
  Synthetic construct
CADW

SEQ ID NO: 657 - protein, 4 aa, Artificial Sequence
  Synthetic construct
YGDW

SEQ ID NO: 658 - protein, 4 aa, Artificial Sequence
  Synthetic construct
DGDW

SEQ ID NO: 659 - protein, 4 aa, Artificial Sequence
  Synthetic construct
CYDW

SEQ ID NO: 660 - protein, 4 aa, Artificial Sequence
  Synthetic construct
CEDW

SEQ ID NO: 661 - protein, 7 aa, Artificial Sequence
  Synthetic construct
ELFGGPS

SEQ ID NO: 662 - protein, 7 aa, Artificial Sequence
  Synthetic construct
ELYGGPS

SEQ ID NO: 663 - protein, 7 aa, Artificial Sequence
  Synthetic construct
ELHGGPS

SEQ ID NO: 664 - protein, 7 aa, Artificial Sequence
  Synthetic construct
ELQGGPS

SEQ ID NO: 665 - protein, 7 aa, Artificial Sequence
  Synthetic construct
ELIGGPS

SEQ ID NO: 666 - protein, 7 aa, Artificial Sequence
  Synthetic construct
ELMGGPS

SEQ ID NO: 667 - protein, 7 aa, Artificial Sequence
  Synthetic construct
ELNGGPS

SEQ ID NO: 668 - protein, 7 aa, Artificial Sequence
  Synthetic construct
ELKGGPS

SEQ ID NO: 669 - protein, 7 aa, Artificial Sequence
  Synthetic construct
ELVGGPS

SEQ ID NO: 670 - protein, 7 aa, Artificial Sequence
  Synthetic construct
ELEGGPS

SEQ ID NO: 671 - protein, 7 aa, Artificial Sequence
  Synthetic construct
ELDGGPS

SEQ ID NO: 672 - protein, 7 aa, Artificial Sequence
  Synthetic construct
ELSGGPS

SEQ ID NO: 673 - protein, 7 aa, Artificial Sequence
  Synthetic construct
ELCGGPS

SEQ ID NO: 674 - protein, 7 aa, Artificial Sequence
  Synthetic construct
ELWGGPS

SEQ ID NO: 675 - protein, 7 aa, Artificial Sequence
  Synthetic construct
ELPGGPS

SEQ ID NO: 676 - protein, 7 aa, Artificial Sequence
  Synthetic construct
ELRGGPS

SEQ ID NO: 677 - protein, 7 aa, Artificial Sequence
  Synthetic construct
ELTGGPS

SEQ ID NO: 678 - protein, 7 aa, Artificial Sequence
  Synthetic construct
ELAGGPS

SEQ ID NO: 679 - protein, 7 aa, Artificial Sequence
  Synthetic construct
ELGGGPS

SEQ ID NO: 680 - protein, 6 aa, Artificial Sequence
  Synthetic construct
PVAGPS

What is claimed is:

1. An immunoglobulin G (IgG) antibody comprising a Fab region and an Fc region connected through a hinge region, wherein the hinge region comprises a protease resistant sequence comprising the amino acid sequence of CWDW (SEQ ID NO: 648), EETCWDW (SEQ ID NO:545), EDSCWDW (SEQ ID NO:546), EETCWSW (SEQ ID NO: 547), ETCWDW (SEQ ID NO:647), DSCWDW (SEQ ID NO:646), YDCWDW (SEQ ID NO: 645), DDCWDW (SEQ ID NO:644), DMCWDW (SEQ ID NO:643), EHCWDW (SEQ ID NO: 642), IICWDW (SEQ ID NO:641), DVCWDW (SEQ ID NO:640), EFCWDW (SEQ ID NO: 639), FNCWDW (SEQ ID NO:638), EETCWDW (SEQ ID NO:545), or EDSCWDW (SEQ ID NO: 546).

2. The IgG antibody of claim 1, wherein the IgG antibody is an IgG1 antibody, an IgG2 antibody, an IgG3 antibody, or an IgG4 antibody.

3. The IgG antibody of claim 1, wherein the hinge region is resistant to cleavage by a protease.

4. The IgG antibody of claim 1, wherein the protease resistant sequence is between amino acid positions 246-252 according to Kabat numbering.

5. The IgG antibody of claim 1, wherein the protease resistant sequence comprises the amino acid sequence CWDW (SEQ ID NO:648).

6. The IgG antibody of claim 1, wherein the protease resistant sequence comprises the amino acid sequence of EETCWDW (SEQ ID NO:545).

7. The IgG antibody of claim 1, wherein the Fc region has a dissociation constant of about $1\times10^{-5}$ M to about $1\times10^{-13}$ M to one or more of CD32 (FcγRII), CD16 (FcγRIII), and CD64 (FcγRI).

8. The IgG antibody of claim 1, wherein the protease is selected from the group consisting of IdeS, IdeZ, pepsin, matrix metalloproteinase 7, matrix metalloproteinase 3, matrix metalloproteinase, cathepsin G, and glutamyl endo-peptidase V8.

9. The IgG antibody of claim 1, wherein the Fc region comprises an amino acid substitution selected from S252D, 1351E, and A349L according to Kabat numbering and wherein the substitution confers higher binding affinity for CD16 (FcγRIII) compared to wild type IgG antibody.

10. The IgG antibody of claim 1, wherein hinge region consists of the protease resistant sequence.

11. The IgG antibody of claim 10, wherein the protease resistance sequence is the amino acid sequence of CWDW (SEQ ID NO:648).

12. The IgG antibody of claim 10, wherein the protease resistance sequence is the amino acid sequence of EETCWDW (SEQ ID NO:545).

13. A recombinant protein comprising:
(i) a Type I transmembrane domain; and
(ii) the IgG immunoglobulin G (IgG) antibody of claim 1;
   wherein the Type I transmembrane domain is fused to the C-terminus of the IgG antibody; and wherein the recombinant protein is resistant to cleavage by a protease.

14. The recombinant protein of claim 13, wherein the Type I transmembrane domain is capable of dimerization.

15. The recombinant protein of any one of claim 13, wherein the Type I transmembrane domain is selected from the group consisting of an EGFR, a PDGFR-alpha, a PDGFR-beta, a HER2, a HER3, a HER4, a FGFR1, a FGFR2, a FGFR3, a FGFR4, a VEGFR1, a VEGFR2, a VEGFR3, a Trk-A, a Trk-B, a Trk-C, and an insulin receptor transmembrane domain.

16. The recombinant protein of claim 13, wherein the Type I transmembrane domain is an EGFR transmembrane domain.

17. An isolated nucleic acid encoding the recombinant protein of claim 13.

18. An expression vector comprising a nucleic acid encoding the recombinant protein of claim 13.

19. A cell comprising the expression vector of claim 18.

20. A method of binding a ligand to a Chinese hamster ovary (CHO) cell surface recombinant protein, the method comprising contacting the ligand with the CHO cell surface recombinant protein, wherein the CHO cell surface recombinant protein comprises:
(i) an EGFR-transmembrane domain; and
(ii) the IgG immunoglobulin G (IgG) antibody of claim 1;
   wherein the EGFR-transmembrane domain is fused to the C-terminus of the IgG antibody; and wherein the IgG antibody is capable of binding the ligand; and
   wherein the CHO cell surface protein is resistant to cleavage by an IgG-specific protease or has higher binding affinity for one or more of CD32 (FcγRII), CD16 (FcγRIII), and CD64 (FcγRI).

* * * * *